United States Patent
McCoy et al.

(10) Patent No.: US 11,046,984 B2
(45) Date of Patent: Jun. 29, 2021

(54) ALPHA (1,2) FUCOSYLTRANSFERASE SYNGENES FOR USE IN THE PRODUCTION OF FUCOSYLATED OLIGOSACCHARIDES

(71) Applicant: Glycosyn LLC, Waltham, MA (US)

(72) Inventors: John M. McCoy, Reading, MA (US); Matthew Ian Heidtman, Brighton, MA (US); Massimo Merighi, Somerville, MA (US)

(73) Assignee: Glycosyn LLC, Waltham, MA (US)

( * ) Notice: Subject to any disclaimer, the term of this patent is extended or adjusted under 35 U.S.C. 154(b) by 0 days.

(21) Appl. No.: 15/307,914

(22) PCT Filed: May 14, 2015

(86) PCT No.: PCT/US2015/030823
§ 371 (c)(1),
(2) Date: Oct. 31, 2016

(87) PCT Pub. No.: WO2015/175801
PCT Pub. Date: Nov. 19, 2015

(65) Prior Publication Data
US 2017/0081353 A1 Mar. 23, 2017

Related U.S. Application Data

(60) Provisional application No. 61/993,742, filed on May 15, 2014.

(51) Int. Cl.
| | |
|---|---|
| *C12N 1/21* | (2006.01) |
| *C12P 19/18* | (2006.01) |
| *C12P 19/28* | (2006.01) |
| *C12N 9/12* | (2006.01) |
| *C12N 9/10* | (2006.01) |
| *C12P 19/00* | (2006.01) |
| *C07H 13/04* | (2006.01) |
| *C12N 15/70* | (2006.01) |
| *C12P 19/04* | (2006.01) |

(52) U.S. Cl.
CPC .............. *C12P 19/18* (2013.01); *C07H 13/04* (2013.01); *C12N 9/1051* (2013.01); *C12N 15/70* (2013.01); *C12P 19/00* (2013.01); *C12P 19/04* (2013.01); *C12Y 204/01069* (2013.01); *C12Y 204/01086* (2013.01); *C12Y 204/01149* (2013.01)

(58) Field of Classification Search
None
See application file for complete search history.

(56) References Cited

U.S. PATENT DOCUMENTS

| | | | |
|---|---|---|---|
| 7,521,212 B1 * | 4/2009 | Samain | A61P 3/10 435/84 |
| 9,029,136 B2 | 5/2015 | Heidtman et al. | |
| 9,453,230 B2 | 9/2016 | Merighi et al. | |
| 9,587,241 B2 | 3/2017 | Merighi et al. | |
| 9,970,018 B2 | 5/2018 | Merighi et al. | |
| 2010/0120701 A1 | 5/2010 | McCoy et al. | |
| 2012/0208181 A1 * | 8/2012 | Merighi | C12N 9/00 435/6.1 |
| 2014/0031541 A1 | 1/2014 | Heidtman et al. | |

FOREIGN PATENT DOCUMENTS

| | | | |
|---|---|---|---|
| CN | 103328630 A | 9/2013 | |
| JP | 2014-506474 A | 3/2014 | |
| WO | WO-2014018596 A2 | 1/2014 | |
| WO | WO-2015150328 A1 * | 10/2015 | .............. C12P 19/18 |

OTHER PUBLICATIONS

Kobata, Isolation of oligosaccharides from human milk, Methods Enz., 1972, 28, 262-71.*
Uniprot, Accession No. D9RUY6, 2014, www.uniprot.org.*
Guo et al., Protein tolerance to random amino acid change, Proc. Natl. Acad. Sci. USA, 2004,101, 9205-10.*
Sigma-Aldrich, Prod. No. G5653, 1997.*
Engles et al., WbgL: a novel bacterial α1,2-fucosyltransferase for the synthesis of 2'-fucosyllactose, Glyobiology, Nov. 2013, 24, 170-78.*
Uniprot, Accession No. A6M9C2, www.uniprot.org.*
Baumgartner et al., Synthesis of fucosylated lacto-N-tetraose using whole cell biotransformation, Bioorg. & Medicinal Chem., Oct. 2015, 23, 6799-806.*
Uniprot, Accession No. B8GDY9, 2013, www.uniprot.org.*
Martin et al., Lewis X biosynthesis in Helicobacer pylori, J. Biol. Chem., 1997, 272, 21349-56.*
Jung et al., Production of 3-Fucosyllactose in Engineered *Escherichia coli* with α-1,3-Fucosyltransferase from Helicobacter pylori, Biotechnol. J., 2019, 14, 1800498.*
Baumgartner et al., Construction of *Escherichia coli* strains with chromosomally integrated expression cassettes for the synthesis of 2'-fucosyllactose. Microb Cell Fact. May 1, 2013;12:40.
Bayer, T. Biotechnological production of fucosylated human milk oligosaccharides (HMO) and core structures thereof. Graz University of Technology Master thesis, 2014, pp. 1-162. <https://diglib.tugraz.at/download.php?id=576a763d797ed&location=browse>.
Choi et al., Engineering of alpha1,2/alpha1,3-fucosyltransferase to improve yield and productivity for the production of 2'-/3-fucosyllactose of HMO. Korean Society for Biotechnology and Bioengineering (Abstract Only), 2013, p. 214. <http://www.dbpia.co.kr/Journal/PDFViewNew?id=N0DE02287489&prev-PathCode=>.

(Continued)

*Primary Examiner* — Robert B Mondesi
*Assistant Examiner* — Todd M Epstein
(74) *Attorney, Agent, or Firm* — Mintz Levin Cohn Ferris Glovsky and Popeo, P.C.; Ingrid A. Beattie

(57) ABSTRACT

The invention provides compositions and methods for engineering *E. coli* or other host production bacterial strains to produce fucosylated oligosaccharides, and the use thereof in the prevention or treatment of infection.

31 Claims, 19 Drawing Sheets
Specification includes a Sequence Listing.

(56) References Cited

OTHER PUBLICATIONS

Han et al., Biotechnological production of human milk oligosaccharides. Biotechnol Adv. Nov.-Dec. 2012;30(6):1268-78.
Kajiwara et al., Isolation of fucosyltransferase-producing bacteria from marine environments. Microbes Environ. 2012;27(4):515-8.
Lee et al., Whole cell biosynthesis of a functional oligosaccharide, 2'-fucosyllactose, using engineered *Escherichia coli*. Microb Cell Fact. Apr. 30, 2012;11:48.
UniParc Accession No. UPI00000BD7C3, 1999.
UniParc Accession No. UPI000156E7D1, 2007.
UniParc Accession No. UPI00017402F0, 2008.
UniParc Accession No. UPI0001848D3F, 2008.
UniParc Accession No. UPI0002135809, 2011.
UniParc Accession No. UPI0002D1E562, 2013.
UniParc Accession No. UPI000335587F, 2013.
Albermann et al., Synthesis of the milk oligosaccharide 2'-fucosyllactose using recombinant bacterial enzymes. Carbohydr Res. Aug. 23, 2001;334(2):97-103.
Altschul et al., Basic local alignment search tool. J Mol Biol. Oct. 5, 1990;215(3):403-10.
Altschul et al., Gapped BLAST and PSI-BLAST: a new generation of protein database search programs. Nucleic Acids Res. Sep. 1, 1997;25(17):3389-402.
Amonsen et al., Human parainfluenza viruses hPIV1 and hPIV3 bind oligosaccharides with alpha2-3-linked sialic acids that are distinct from those bound by H5 avian influenza virus hemagglutinin. J Virol. Aug. 2007;81(15):8341-5.
Bachmann, B. Pedigrees of some mutant strains of *Escherichia coli* K-12. Bacteriol Rev. Dec. 1972;36(4):525-57.
Belfort et al., Characterization of the *Escherichia coli* thyA gene and its amplified thymidylate synthetase product. Proc Natl Acad Sci U S A. Apr. 1983;80(7):1858-61.
Bettler et al., The living factory: in vivo production of N-acetyllactosamine containing carbohydrates in *E. coli*. Glycoconj J. Mar. 1999;16(3):205-12.
Bode L. Recent advances on structure, metabolism, and function of human milk; oligosaccharides. J Nutr. Aug. 2006;136(8):2127-30.
Charlwood et al., A detailed analysis of neutral and acidic carbohydrates in human milk. Anal Biochem. Sep. 10, 1999;273(2):261-77.
Chaturvedi et al., Fucosylated human milk oligosaccharides vary between individuals and over the course of lactation. Glycobiology. May 2001;11(5):365-72.
Chaturvedi et al., Survival of human milk oligosaccharides in the intestine of infants. Adv Exp Med Biol. 2001;501:315-23.
Couceiro et al., Influenza virus strains selectively recognize sialyloligosaccharides on human respiratory epithelium; the role of the host cell in selection of hemagglutinin receptor specificity. Virus Res. Aug. 1993;29(2):155-65.
Court et al., Genetic engineering using homologous recombination. Annu Rev Genet. 2002;36:361-88.
Crout et al., Glycosidases and glycosyl transferases in glycoside and oligosaccharide synthesis. Curr Opin Chem Biol. Feb. 1998;2(1):98-111.
Danchin, A. Cells need safety valves. Bioessays. Jul. 2009;31(7):769-73.
Drouillard et al., Large-scale synthesis of H-antigen oligosaccharides by expressing Helicobacter pylori alphal,2-fucosyltransferase in metabolically engineered *Escherichia coli* cells. Angew Chem Int Ed Engl. Mar. 3, 2006;45(11):1778-80.
Dumon et al., Assessment of the two Helicobacter pylori alpha-1,3 fucosyltransferase ortholog genes for the large-scale synthesis of LewisX human milk oligosaccharides by metabolically engineered *Escherichia coli*. Biotechnol Prog. Mar.-Apr. 2004;20(2):412-9.
Dumon et al., In vivo fucosylation of lacto-N-neotetraose and lacto-N-neohexaose by heterologous; expression of Helicobacter pylori alpha-1,3 fucosyltransferase in engineered *Escherichia coli*. Glycoconj J. Jun. 2001;18(6):465-74.

Dumon et al., Production of Lewis x tetrasaccharides by metabolically engineered *Escherichia coli*. Chembiochem. Feb. 2006;7(2):359-65.
Endo et al., Large-scale production of CMP-NeuAc and sialylated oligosaccharides through bacterial coupling. Appl Microbiol Biotechnol. Mar. 2000;53(3):257-61.
Endo et al., Large-scale production of N-acetyllactosamine through bacterial coupling. Carbohydr Res. Mar. 31, 1999;316(1-4):179-83.
Endo et al., Large-scale production of oligosaccharides using engineered; bacteria. Curr Opin Struct Biol. Oct. 2000;10(5):536-41.
Endo et al., Large-scale production of the carbohydrate portion of the sialyl-Tn epitope, alpha-Neup5Ac-(2—>6)-D-GalpNAc, through bacterial coupling. Carbohydr Res. Feb. 28, 2001;330(4):439-43.
Flowers, H. Chemical synthesis of oligosaccharides. Methods Enzymol. 1978;50:93-121.
Gottesman et al., Regulation of capsular polysaccharide synthesis in *Escherichia coli* K12. Mol Microbiol. Jul. 1991;5(7):1599-606.
Hamosh M. Bioactive factors in human milk. Pediatr Clin North Am.; Feb. 2001;48(1):69-86.
Johnson, K. Synthesis of oligosaccharides by bacterial enzymes. Glycoconj J. Feb. 1999;16(2):141-6.
Koeller et al., Synthesis of complex carbohydrates and glycoconjugates: enzyme-based and programmable one-pot strategies. Chem Rev. Dec. 13, 2000;100(12):4465-94.
Koizumi et al., Large-scale production of UDP-galactose and globotriose by coupling metabolically engineered bacteria. Nat Biotechnol. Sep. 1998;16(9):847-50.
Kuhlenschmidt et al., Sialic acid dependence and independence of group A rotaviruses. Adv Exp Med Biol. 1999;473:309-17.
Kunz et al., Oligosaccharides in human milk: structural, functional, and metabolic aspects. Annu Rev Nutr. 2000;20:699-722.
LaVallie et al., A thioredoxin gene fusion expression system that circumvents inclusion body; formation in the *E. coli* cytoplasm. Biotechnology (N Y). Feb. 1993;11(2):187-93.
LaVallie et al., Thioredoxin as a fusion partner for production of soluble recombinant proteins in *Escherichia coli*. Methods Enzymol. 2000;326:322-40.
Li et al., Characterization of a novel alphal,2-fucosyltransferase of *Escherichia coli* O128:b12 and functional investigation of its common motif. Biochemistry. Jan. 8, 2008;47(1):378-87.
Mandavi et al., Helicobacter pylori SabA adhesin in persistent infection and chronic inflammation. Science. Jul. 26, 2002;297(5581):573-8.
Marcobal et al., Consumption of human milk oligosaccharides by gut-related microbes. J Agric Food Chem. May 12, 2010;58(9):5334-40.
Martín-Sosa et al., Sialyloligosaccharides in human and bovine milk and in infant formulas: variations with the progression of lactation. J Dairy Sci. Jan. 2003;86(1):52-9.
Mieschendahl et al., A Novel Prophage Independent TRP Regulated Lambda PL Expression System. Bio/Technology. 1986;4:802-8.
Morrow et al., Human milk oligosaccharides are associated with protection against diarrhea in breast-fed infants. J Pediatr. Sep. 2004;145(3):297-303.
Newburg, D. Bioactive components of human milk: evolution, efficiency, and; protection. Adv Exp Med Biol. 2001;501:3-10.
Newburg, D. Human milk glycoconjugates that inhibit pathogens. Curr Med Chem. Feb. 1999;6(2):117-27.
Newburg et al., Human milk glycans protect infants against enteric pathogens. Annu Rev Nutr. 2005;25:37-58.
Newburg et al., Innate protection conferred by fucosylated oligosaccharides of human milk against diarrhea in breastfed infants. Glycobiology. Mar. 2004;14(3):253-63.
Newburg et al., Protection of the neonate by the innate immune system of developing gut and of human milk. Pediatr Res. Jan. 2007;61(1):2-8.
Newburg et al., Role of human-milk lactadherin in protection against symptomatic rotavirus infection. Lancet. Apr. 18, 1998;351(9110):1160-4.
Ninonuevo et al., A strategy for annotating the human milk glycome. J Agric Food Chem. Oct. 4, 2006;54(20):7471-80.
Palcic, M. Biocatalytic synthesis of oligosaccharides. Curr Opin Biotechnol.; Dec. 1999;10(6):616-24.

(56) References Cited

OTHER PUBLICATIONS

Parkkinen et al., Isolation of sialyl oligosaccharides and sialyl oligosaccharide phosphates from bovine colostrum and human urine. Methods Enzymol. 1987;138:289-300.
Rabbani et al., Molecular cloning and functional expression of a novel Helicobacter pylori alpha-1,4 fucosyltransferase. Glycobiology. Nov. 2005;15(11):1076-83.
Rasko et al., Cloning and characterization of the alpha(1,3/4) fucosyltransferase of Helicobacter pylori. J Biol Chem. Feb. 18, 2000;275(7):4988-94.
Ruffing et al., Metabolic engineering of microbes for oligosaccharide and polysaccharide synthesis. Microb Cell Fact. Jul. 21, 2006;5:25.
Ruiz-Palacios et al., Campylobacter jejuni binds intestinal H(O) antigen (Fuc alpha 1, 2Gal beta 1, 4GlcNAc), and fucosyloligosaccharides of human milk inhibit its binding and infection. J Biol Chem. Apr. 18, 2003;278(16):14112-20.
Rydell et al., Human noroviruses recognize sialyl Lewis x neoglycoprotein. Glycobiology. Mar. 2009;19(3):309-20.
Sanger et al., Nucleotide sequence of bacteriophage lambda DNA. J Mol Biol. Dec. 25, 1982;162(4):729-73.
Scharfman et al., Sialyl-Le(x) and sulfo-sialyl-Le(x) determinants are receptors for P. aeruginosa. Glycoconj J. Oct. 2000;17(10):735-40.
Seeberger, P. Automated carbohydrate synthesis to drive chemical glycomics. Chem Commun (Camb). May 21, 2003;(10):1115-21.
Shen et al., Resolution of structural isomers of sialylated oligosaccharides by capillary electrophoresis. J Chromatogr A. Jul. 6, 2001;921(2):315-21.
Stein et al., Cloning genes for proline biosynthesis from Neisseria gonorrhoeae: identification by interspecific complementation of *Escherichia coli* mutants. J Bacteriol. May 1984;158(2):696-700.
Stevenson et al., Organization of the *Escherichia coli* K-12 gene cluster responsible for production of the extracellular polysaccharide colanic acid. J Bacteriol. Aug. 1996;178(16):4885-93.
Wolfe et al., Nucleotide sequence and analysis of the purA gene encoding; adenylosuccinate synthetase of *Escherichia coli* K12. J Biol Chem. Dec. 1988; 15;263(35)1 9147-53.
Wymer et al., Enzyme-catalyzed synthesis of carbohydrates. Curr Opin Chem Biol. Feb. 2000;4(1):110-9.
GenBank Database (Apr. 27, 1993) "Kluyveromyces Lactis Beta-D-Galactosidase (LAC4) Gene, Complete CDS", GenBank Accession No. M84410.1, 2 pages.
GenBank Database (Mar. 17, 1994) "*E. coli* ATP-dependent Protease La (Ion) Gene, Complete CDS", GenBank Accession No. L20572.1, 2 pages.
GenBank Database (Dec. 6, 1995) "*Escherichia coli* Capsular Polysaccharide Regulator (rcsA) Gene, Complete CDS", GenBank Accession No. M58003.1, 2 pages.
GenBank Database (May 4, 1999) "alpha-1,2-fucosyltransferase [Helicobacter pylori]", GenBank Accession No. AAD29869.1, 1 page.
GenBank Database (Oct. 16, 1999) "wblA [Vibrio cholerae]", GenBank Accession No. BAA33632.1, 1 page.
GenBank Database (Feb. 20, 2003) "Helicobacter Pylori Alpha-1,3/4-Fucosyltransferas (fucTa) Gene, Complete Cds", GenBank Accession No. AF194963.2, 2 pages.
GenBank Database (Oct. 3, 2003) "putative fucosyltransferase [*Escherichia coli*]", GenBank Accession No. AAO37698.1, 1 page.
GenBank Database (Oct. 25, 2005) "Helicobacter Pylori Strain DSM 6709 Alpha-1, 4 Fucosyltransferas (FfucTIII) gene, Complete CDS", GenBank Accession No. AY450598.1, 2 pages.
GenBank Database (Nov. 4, 2005) "DNA Sequence of rcsB Gene which is Regulator Gene of Capsule Polysaccharide Systhesis Gene (CPS Gene)", GenBank Accession No. E04821.1, 2 pages.
GenBank Database (Dec. 6, 2005) "putative fucosyltransferase [*Escherichia coli*]", GenBank Accession No. AAO37719.1, 1 page.
GenBank Database (Nov. 20, 2008) "Predicted UDP-Glucose lipid Carrier Transferase (*Escherichia coli* str. K-12 substr. W3110)", GenBank Accession No. BAA15900.1, 13 pages.
GenBank Database (Dec. 27, 2011) "JP 2011167200—A/17:H. Pylori Fucosyltransferases", GenBank Accession No. HV532291.1, 1 page.
GenBank Database (Apr. 10, 2012) "glycosyltransferase [Providencia alcalifaciens]", GenBank Accession No. AFH02807.1, 1 page.
GenBank Database (Sep. 26, 2012) "glycosyl transferase family 11 [uncultured bacterium]", GenBank Accession No. EKE06679.1, 1 page.
GenBank Database (Sep. 26, 2012) "glycosyl transferase family protein [uncultured bacterium]", GenBank Accession No. EKE02186.1, 1 page.
Genbank Database (Sep. 26, 2012) "glycosyl transferase family 11 [uncultured bacterium]", GenBank Accession No. EKE06672.1, 1 page.
GenBank Database (Sep. 26, 2012) "glycosyl transferase family protein [uncultured bacterium]", GenBank Accession No. EKD23702.1, 1 page.
GenBank Database (Sep. 26, 2012) "hypothetical protein ACD_46C00193G0003 [uncultured bacterium]", GenBank Accession No. EKD71402.1, 1 page.
GenBank Database (May 29, 2013) "hypothetical protein C819_03052 [Lachnospiraceae bacterium 10-1]", GenBank Accession No. E0574299.1, 2 pages.
GenBank Database (Jun. 4, 2013) "Glycosyl transferase family 11/Glycosyltransferase family 6 [Desulfovibrio africanus]", GenBank Accession No. WP_005984176.1, 1 page.
GenBank Database (Jun. 4, 2013) "hypothetical protein [Bacteroides fragilis]", GenBank Accession No. WP_005822375.1, 1 page.
GenBank Database (Jun. 29, 2013) "hypothetical protein [Polaribacter franzmannii]", GenBank Accession No. WP_018944517.1, 1 page.
GenBank Database (Aug. 27, 2013) "glycosyltransferase [*Salmonella enterica*]", GenBank Accession No. AFW04804.1, 1 page.
GenBank Database (Dec. 10, 2013) "hypothetical protein HMPREF1199_00667 [Prevotella oralis CC98A]", GenBank Accession No. ETD21592.1, 2 pages.
GenBank Database (Feb. 28, 2014) "alpha-1,2-fucosyltransferase [*Thermosynechococcus* sp. NK55a]", GenBank Accession No. AHB87954.1, 1 page.
GenBank Database (Dec. 16, 2014) "glycosyl transferase family protein [Methanosphaerula palustris E1-9c]", GenBank Accession No. YP_002467213.1, 2 pages.
GenBank Database (Dec. 16, 2014) "alpha-1,2-fucosyltransferase [Gramella forsetii KT0803]", GenBank Accession No. YP_860609.1, 2 pages.
GenBank Database (Dec. 16, 2014) "alpha-1,2-fucosyltransferase [Syntrophus aciditrophicus SB]", GenBank Accession No. YP_462663.1, 2 pages.
GenBank Database (Dec. 16, 2014) "alpha-1,2-fucosyltransferase, putative [Ruegeria pomeroyi DSS-3]", GenBank Accession No. YP_168587.1, 2 pages.
GenBank Database (Dec. 16, 2014) "fucosyltransferase [*Escherichia coli* O127:H6 str. E2348/69]", GenBank Accession No. YP_002329683.1, 2 pages.
GenBank Database (Dec. 16, 2014) "glycoside hydrolase family protein [Geobacter lovleyi SZ]", GenBank Accession No. YP_001952981.1, 2 pages.
GenBank Database (Dec. 16, 2014) "glycosyl transferase [Desulfovibrio alaskensis G20]", GenBank Accession No. YP_389367.1, 2 pages.
GenBank Database (Dec. 16, 2014) "glycosyl transferase family protein [Bacteroides vulgatus ATCC 8482]", GenBank Accession No. YP_001300461.1, 2 pages.
GenBank Database (Dec. 16, 2014) "glycosyl transferase family protein [Methanococcus maripaludis C7]", GenBank Accession No. YP_001329558.1, 2 pages.
GenBank Database (Dec. 16, 2014) "glycosyl transferase family protein [Desulfovibrio vulgaris str. 'Miyazaki F']", GenBank Accession No. YP_002437106.1, 2 pages.
GenBank Database (Dec. 16, 2014) "glycosyl transferase family protein [Chlorobium phaeobacteroides BS1]", GenBank Accession No. YP_001960319.1, 2 pages.
GenBank Database (Dec. 16, 2014) "glycosyl transferase family protein [Bacteroides vulgatus ATCC 8482]", GenBank Accession No. YP_001300694.1, 2 pages.

(56) References Cited

OTHER PUBLICATIONS

GenBank Database (Dec. 16, 2014) "glycosyltransferase [Geobacter metallireducens GS-15]", GenBank Accession No. YP_006720295.1, 2 pages.
GenBank Database (Dec. 17, 2014) "alpha-1,2-fucosyltransferase [Helicobacter mustelae 12198]", GenBank Accession No. YP_003517185.1, 2 pages.
Genbank Database (Dec. 17, 2014) "alpha-1,2-fucosyltransferase [Colwellia psychrerythraea 34H]", GenBank Accession No. YP_270849.1, 2 pages.
GenBank Database (Dec. 17, 2014) "alpha-1,2-fucosyltransferase [*Pseudovibrio* sp. FO-BEG1]", GenBank Accession No. YP_005080114.1, 2 pages.
GenBank Database (Dec. 17, 2014) "glycosyl transferase 11 [Butyrivibrio proteoclasticus B316]", GenBank Accession No. YP_003829743.1, 2 pages.
GenBank Database (Dec. 17, 2014) "glycosyl transferase 11 [Butyrivibrio proteoclasticus B316]", GenBank Accession No. YP_003831842.1, 2 pages.
GenBank Database (Dec. 17, 2014) "glycosyl transferase 11 [Butyrivibrio proteoclasticus B316]", GenBank Accession No. YP_003829826.1, 2 pages.
GenBank Database (Dec. 17, 2014) "glycosyl transferase 11 [Butyrivibrio proteoclasticus B316]", GenBank Accession No. YP_003829733.1, 2 pages.
GenBank Database (Dec. 17, 2014) "glycosyl transferase 11 [Butyrivibrio proteoclasticus B316]", GenBank Accession No. YP_003829712.1, 2 pages.
GenBank Database (Dec. 17, 2014) "glycosyl transferase family protein [Akkermansia muciniphila ATCC BAA-835]", GenBank Accession No. YP_001877555.1, 2 pages.
GenBank Database (Dec. 17, 2014) "glycosyl transferase family protein [Methylotenera mobilis JLW8]", GenBank Accession No. YP_003048467.1, 2 pages.
GenBank Database (Dec. 17, 2014) "Glycosyl transferase family 11 [Dechlorosoma suillum PS]", GenBank Accession No. YP_005026324.1, 2 pages.
GenBank Database (Dec. 17, 2014) "glycosyl transferase family 11 [Sideroxydans lithotrophicus ES-1]", GenBank Accession No. YP_003525501.1, 2 pages.
GenBank Database (Dec. 17, 2014) "glycosyl transferase family protein [Pedobacter heparinus DSM 2366]", GenBank Accession No. YP_003090434.1, 2 pages.
GenBank Database (Dec. 17, 2014) "glycosyl transferase family protein [Geobacter uraniireducens Rf4]", GenBank Accession No. YP_001230447.1, 2 pages.
GenBank Database (Dec. 17, 2014) "glycosyl transferase family protein [Sulfurospirillum deleyianum DSM 6946]", GenBank Accession No. YP_003304837.1, 2 pages.
GenBank Database (Dec. 17, 2014) "glycosyl transferase family protein [Mesotoga prima MesG1.Ag.4.2]", GenBank Accession No. YP_006346113.1, 2 pages.
GenBank Database (Dec. 17, 2014) "glycosyl transferase family 11 [Fibrella aestuarina BUZ 2]", GenBank Accession No. YP_007319049.1, 2 pages.
GenBank Database (Dec. 17, 2014) "glycosyl transferase family protein [*Geobacter* sp. M18]", GenBank Accession No. YP_004197726.1, 2 pages.
GenBank Database (Dec. 17, 2014) "glycosyl transferase family protein [Marinomonas posidonica IVIA-Po-181]", GenBank Accession No. YP_004480472.1, 2 pages.
GenBank Database (Dec. 17, 2014) "glycosyl transferase family protein [Roseburia hominis A2-183]", GenBank Accession No. YP_004839455.1, 2 pages.
GenBank Database (Dec. 17, 2014) "glycosyl transferase family protein [Desulfomicrobium baculatum DSM 4028]", GenBank Accession No. YP_003159045.1, 2 pages.
GenBank Database (Dec. 17, 2014) "glycosyl transferase family protein [Planctomyces brasiliensis DSM 5305]", GenBank Accession No. YP_004271766.1, 2 pages.
GenBank Database (Dec. 17, 2014) "glycosyltransferase family 11 [Prevotella melaninogenica ATCC 25845]", GenBank Accession No. YP_003814512.1, 1 page.
GenBank Database (Dec. 17, 2014) "hypothetical protein Sdel_1779 [Sulfurospirillum deleyianum DSM 6946]", GenBank Accession No. YP_003304829.1, 2 pages.
GenBank Database (Dec. 17, 2014) "putative LPS biosynthesis alpha-1,2-fucosyltransferase [Bacteroides fragilis 638R]", GenBank Accession No. YP_005110943.1, 2 pages.
GenBank Database (Dec. 18, 2014) "family 11 glycosyl transferase [Prevotella ruminicola 23]", GenBank Accession No. YP_003574648.1, 2 pages.
GenBank Database (Dec. 18, 2014) "fucosyltransferase [*Salmonella enterica* subsp. enterica serovar Cubana str. CFSAN002050]", GenBank Accession No. YP_008261369.1, 2 pages.
GenBank Database (Dec. 18, 2014) "glycosyl transferase [*Carnobacterium* sp. WN1359]", GenBank Accession No. YP_008718687.1, 2 pages.
GenBank Database (Dec. 18, 2014) "glycosyl transferase family protein [Runella slithyformis DSM 19594]", GenBank Accession No. YP_004658567.1, 2 pages.
GenBank Database (Dec. 18, 2014) "glycosyl transferase family 11 [*Polaribacter* sp. MED152]", GenBank Accession No. YP_007670847.1, 2 pages.
GenBank Database (Dec. 18, 2014) "glycosyl transferase family 11 [*Carnobacterium* sp. WN1359]", GenBank Accession No. YP_008718688.1, 2 pages.
GenBank Database (Dec. 18, 2014) "glycosyltransferase [Candidatus symbiobacter mobilis CR]", GenBank Accession No. YP_008680725.1, 2 pages.
GenBank Database (Dec. 18, 2014) "hypothetical protein HMPREF0669_00176 (plasmid) [*Prevotella* sp. oral taxon 299 str. F0039]", GenBank Accession No. YP_008444280.1, 2 pages.
GenBank Database (Dec. 18, 2014) "hypothetical protein PGA1_c33070 [Phaeobacter inhibens DSM 17395]", GenBank Accession No. YP_006574665.1, 2 pages.
GenBank Database (Jul. 26, 2016) "*E. coli* lacY Gene (Codes for Lactose Permease)", GenBank Accession No. V00295.1, 3 pages.
GenBank Database (Aug. 3, 2016) "alpha-1,2-fucosyltransferase [Thermosynechococcus elongatus BP-1]", GenBank Accession No. NP_681784.1, 2 pages.
GenBank Database (Aug. 3, 2016) "family 11 glycosyltransferase [Enterococcus faecium DO]", GenBank Accession No. YP_006376560.1, 2 pages.
GenBank Database (Aug. 28, 2016) "fucosyl transferase [Rhodopirellula baltica SH 1]", GenBank Accession No. NP_868779.1, 2 pages.
GenBank Database (Oct. 7, 2016) "0-antigen Translocase (*Escherichia coli* str. K-12 substr. W3110)", GenBank Accession No. BAE77506.1, 13 pages.
GenBank Database (Oct. 7, 2016) "Colanic Acid Exporter [*Escherichia coli* str. K-12 Substr.W3110)", GenBank Accession No. BAA15899.1, 13 pages.
GenBank Database (Oct. 7, 2016) "Lipoprotein Required for Capsular Polysaccharide Translocation through the Outer Membrane (*Escherichia coli* str. K-12 substr. W3110)", GenBank Accession No. BAE76576.1, 13 pages.
GenBank Database (Oct. 7, 2016) "Predicted Acyl Transferase (*Escherichia coli* str. K-12 substr. W3110)", GenBank Accession No. BAA15910.1, 13 pages.
GenBank Database (Oct. 7, 2016) "Predicted Colanic Acid Polymerase (*Escherichia coli* str. K-12 substr. W31101", GenBank Accession No. BAE76573.1, 13 pages.
GenBank Database (Oct. 7, 2016) "Predicted Glycosyl Transferase (*Escherichia coli* str. K-12 substr. W3110)", GenBank Accession No. BAE76572.1, 13 pages.
GenBank Database (Oct. 7, 2016) "Predicted Glycosyl Transferase (*Escherichia coli* str. K-12 substr. W3110]", GenBank Accession No. BAA15906.1, 12 pages.
GenBank Database (Oct. 7, 2016) "Predicted Glycosyl Transferase (*Escherichia coli* str. K-12 substr. W3110]", GenBank Accession No. BAA15912.1, 13 pages.

(56) References Cited

OTHER PUBLICATIONS

GenBank Database (Oct. 7, 2016) "Predicted Glycosyl Transferase (*Escherichia coli* str. K-12 substr. W3110]", GenBank Accession No. BAE76574.1, 13 pages.
GenBank Database (Oct. 7, 2016) "Predicted Glycosyl Transferas (*Escherichia Coli* Str. K-12 Substr. W3110)", GenBank Accession No. BAA15898.1, 13 pages.
GenBank Database (Oct. 7, 2016) "Protein-Tyrosine kinase (*Escherichia coli* str. K-12 substr. W3110)", GenBank Accession No. BAA15913.1, 13 pages.
GenBank Database (Oct. 7, 2016) "Protein-Tyrosine Phosphatase (*Escherichia coli* str. K-12 substr. W3110]", GenBank Accession No. BAE76575.1, 13 pages.
GenBank Databse (Oct. 7, 2016) "Predicted Acyl Transferase (*Escherichia coli* str. K12 substr. W3110)", GenBank Accession No. BAA15911.1, 13 pages.
Genbank Database (Dec. 9, 2016) "alpha-1,2-fucosyltransferase [Lachnospiraceae bacterium COE1]", GenBank Accession No. WP_016299568.1, 1 page.
GenBank Database (Dec. 9, 2016) "alpha-1,2-fucosyltransferase [Vibrio cholerae]", GenBank Accession No. WP_002030616.1, 1 page.
GenBank Database (Dec. 9, 2016) "alpha-1,2-fucosyltransferase [*Escherichia coli*]", GenBank Accession No. WP_001592236.1, 1 page.
GenBank Database (Dec. 9, 2016) "alpha-1,2-fucosyltransferase [[Clostridium] bolteae]", GenBank Accession No. WP_002570768.1, 1 page.
GenBank Database (Dec. 9, 2016) "alpha-1,2-fucosyltransferase [*Tannerella* sp. CAG:118]", GenBank Accession No. WP_021929367.1, 1 page.
GenBank Database (Dec. 9, 2016) "alpha-1,2-fucosyltransferase [Bacteroides caccae]", GenBank Accession No. WP_005675707.1, 1 page.
GenBank Database (Dec. 9, 2016) "alpha-1,2-fucosyltransferase [*Butyrivibrio* sp. AE2015]", GenBank Accession No. WP_022772718.1, 1 page.
GenBank Database (Dec. 9, 2016) "alpha-1,2-fucosyltransferase [*Prevotella* sp. CAG:891]", GenBank Accession No. WP_022481266.1, 1 page.
GenBank Database (Dec. 9, 2016) "alpha-1,2-fucosyltransferase [Parabacteroides johnsonii]", GenBank Accession No. WP_008155883.1, 1 page.
GenBank Database (Dec. 9, 2016) "alpha-1,2-fucosyltransferase [*Salmonella enterica*]", GenBank Accession No. WP_023214330.1, 1 page.
GenBank Database (Dec. 9, 2016) "alpha-1,2-fucosyltransferase [*Bacteroides* sp. CAG:633]", GenBank Accession No. WP_022161880.1, 1 page.
GenBank Database (Dec. 9, 2016) "alpha-1,2-fucosyltransferase [*Clostridium* sp. CAG:306]", GenBank Accession No. WP_022247142.1, 1 page.
GenBank Database (Dec. 9, 2016) "alpha-1,2-fucosyltransferase [*Prevotella* sp. oral taxon 306]", GenBank Accession No. WP_009434595.1, 1 page.
GenBank Database (Dec. 9, 2016) "alpha-1,2-fucosyltransferase [*Brachyspira* sp. CAG:484]", GenBank Accession No. WP_021917109.1, 1 page.
GenBank Database (Dec. 9, 2016) "alpha-1,2-fucosyltransferase [Thalassospira profundimaris]", GenBank Accession No. WP_008889330.1, 1 page.
GenBank Database (Dec. 9, 2016) "alpha-1,2-fucosyltransferase [*Acetobacter* sp. CAG:267]", GenBank Accession No. WP_022078656.1, 1 page.
GenBank Database (Dec. 9, 2016) "alpha-1,2-fucosyltransferase [Dysgonomonas mossii]", GenBank Accession No. WP_006842165.1, 1 page.
GenBank Database (Dec. 9, 2016) "alpha-1,2-fucosyltransferase [*Clostridium* sp. KLE 1755]", GenBank Accession No. WP_021636924.1, 1 page.
GenBank Database (Dec. 9, 2016) "alpha-1,2-fucosyltransferase [Gillisia limnaea]", GenBank Accession No. WP_006988068.1, 1 page.
GenBank Database (Dec. 9, 2016) "alpha-1,2-fucosyltransferase [*Clostridium* sp. KLE 1755]", GenBank Accession No. WP_021636949.1, 1 page.
GenBank Database (Dec. 9, 2016) "alpha-1,2-fucosyltransferase [Francisella philomiragia]", GenBank Accession No. WP_004287502.1, 1 page.
GenBank Database (Dec. 9, 2016) "alpha-1,2-fucosyltransferase [Pseudomonas fluorescens]", GenBank Accession No. WP_017337316.1, 1 page.
GenBank Database (Dec. 9, 2016) "alpha-1,2-fucosyltransferase [*Herbaspirillum* sp. YR522]", GenBank Accession No. WP_008117381.1, 1 page.
GenBank Database (Dec. 9, 2016) "alpha-1,2-fucosyltransferase [Prevotella histicola]", GenBank Accession No. WP_008822166.1, 1 page.
GenBank Database (Dec. 9, 2016) "alpha-1,2-fucosyltransferase [*Flavobacterium* sp. WG21]", GenBank Accession No. WP_017494954.1, 1 page.
GenBank Database (Dec. 9, 2016) "alpha-1,2-fucosyltransferase [*Gallionella* sp. SCGC AAA018-N21]", GenBank Accession No. WP_018293379.1, 1 page.
GenBank Database (Dec. 9, 2016) "alpha-1,2-fucosyltransferase [Prevotella paludivivens]", GenBank Accession No. WP_018463017.1, 1 page.
GenBank Database (Dec. 9, 2016) "alpha-1,2-fucosyltransferase [Mariprofundus ferrooxydans]", GenBank Accession No. WP_009849029.1, 1 page.
GenBank Database (Dec. 9, 2016) "alpha-1,2-fucosyltransferase [Bacillus cereus]", GenBank Accession No. WP_002174293.1, 1 page.
GenBank Database (Dec. 9, 2016) "alpha-1,2-fucosyltransferase [Firmicutes bacterium CAG:534]", GenBank Accession No. WP_022352106.1, 1 page.
GenBank Database (Dec. 9, 2016) "alpha-1,2-fucosyltransferase [Zeta proteobacterium SCGC AB-137-009]", GenBank Accession No. WP_018281578.1, 1 page.
GenBank Database (Dec. 9, 2016) "alpha-1,2-fucosyltransferase [Rhodobacterales bacterium HTCC2255]", GenBank Accession No. WP_008033953.1, 1 page.
GenBank Database (Dec. 9, 2016) "alpha-1,2-fucosyltransferase [Spirulina subsalsa]", GenBank Accession No. WP_017302658.1, 1 page.
GenBank Database (Dec. 9, 2016) "alpha-1,2-fucosyltransferase [Vibrio cyclitrophicus]", GenBank Accession No. WP_010433911.1, 1 page.
GenBank Database (Dec. 9, 2016) "alpha-1,2-fucosyltransferase [Lachnospiraceae bacterium NK4A179]", GenBank Accession No. WP_022783177.1, 1 page.
GenBank Database (Dec. 9, 2016) "alpha-1,2-fucosyltransferase [*Butyrivibrio* sp. AE3009]", GenBank Accession No. WP_022778576.1, 1 page.
GenBank Database (Dec. 9, 2016) "alpha-1,2-fucosyltransferase [Bacteroides ovatus]", GenBank Accession No. WP_004317929.1, 1 page.
GenBank Database (Dec. 9, 2016) "alpha-1,2-fucosyltransferase [Desulfospira joergensenii]", GenBank Accession No. WP_022664368.1, 1 page.
GenBank Database (Dec. 9, 2016) "alpha-1,2-fucosyltransferase [Bacteroides dorei]", GenBank Accession No. WP_007832461.1, 1 page.
GenBank Database (Dec. 9, 2016) "alpha-1,2-fucosyltransferase [Firmicutes bacterium CAG:24]", GenBank Accession No. WP_021916201.1, 1 page.
GenBank Database (Dec. 9, 2016) "alpha-1,2-fucosyltransferase [Clostridium hathewayi CAG:224]", GenBank Accession No. WP_022031822.1, 1 page.
GenBank Database (Dec. 9, 2016) "alpha-1,2-fucosyltransferase [Bacteroides caccae] ", GenBank Accession No. WP_005678148.1, 1 page.

(56) References Cited

OTHER PUBLICATIONS

GenBank Database (Dec. 9, 2016) "alpha-1,2-fucosyltransferase [Butyrivibrio fibrisolvens]", GenBank Accession No. WP_022756304.1, 1 page.
GenBank Database (Dec. 9, 2016) "alpha-1,2-fucosyltransferase [Lachnospiraceae bacterium A4]", GenBank Accession No. WP_016280341.1, 1 page.
GenBank Database (Dec. 9, 2016) "alpha-1,2-fucosyltransferase [*Roseobacter* sp. MED193]", GenBank Accession No. WP_009810150.1, 1 page.
GenBank Database (Dec. 9, 2016) "alpha-1,2-fucosyltransferase [Cesiribacter andamanensis]", GenBank Accession No. WP_009197396.1, 1 page.
GenBank Database (Dec. 9, 2016) "alpha-1,2-fucosyltransferase [Rhodopirellula sallentina]", GenBank Accession No. WP_008679055.1, 1 page.
GenBank Database (Dec. 9, 2016) "alpha-1,2-fucosyltransferase [Segetibacter koreensis]", GenBank Accession No. WP_018611017.1, 1 page.
GenBank Database (Dec. 9, 2016) "alpha-1,2-fucosyltransferase [Amphritea japonica]", GenBank Accession No. WP_019621022.1, 1 page.
GenBank Database (Dec. 9, 2016) "alpha-1,2-fucosyltransferase [Spirosoma spitsbergense]", GenBank Accession No. WP_020606886.1, 1 page.
GenBank Database (Dec. 9, 2016) "alpha-1,2-fucosyltransferase [Lachnospiraceae bacterium 28-4]", GenBank Accession No. WP_016292012.1, 1 page.
GenBank Database (Dec. 9, 2016) "alpha-1,2-fucosyltransferase [Lachnospiraceae bacterium COE1]", GenBank Accession No. WP_016302211.1, 1 page.
GenBank Database (Dec. 9, 2016) "alpha-1,2-fucosyltransferase [*Bacteroides* sp. HPS0048]", GenBank Accession No. WP_002561428.1, 1 page.
GenBank Database (Dec. 9, 2016) "alpha-1,2-fucosyltransferase [Bacteroides thetaiotaomicron]", GenBank Accession No. WP_016267863.1, 1 page.
GenBank Database (Dec. 9, 2016) "alpha-1,2-fucosyltransferase [Vibrio nigripulchritudo]", GenBank Accession No. WP_022596860.1, 1 page.
GenBank Database (Dec. 9, 2016) "alpha-1,2-fucosyltransferase [*Escherichia coli*]", GenBank Accession No. WP_001581194.1, 1 page.
GenBank Database (Dec. 9, 2016) "alpha-1,2-fucosyltransferase [Firmicutes bacterium CAG:24]", GenBank Accession No. WP_021914998.1, 1 page.
GenBank Database (Dec. 9, 2016) "alpha-1,2-fucosyltransferase [Amphritea japonica]", GenBank Accession No. WP_019622926.1, 1 page.
GenBank Database (Dec. 9, 2016) "alpha-1,2-fucosyltransferase [Bacteroides salyersiae]", GenBank Accession No. WP_005923045.1, 1 page.
GenBank Database (Dec. 9, 2016) "alpha-1,2-fucosyltransferase [Bacteroides fragilis]", GenBank Accession No. WP_005786334.1, 1 page.
GenBank Database (Dec. 9, 2016) "alpha-1,2-fucosyltransferase [Bacteroides nordii]", GenBank Accession No. WP_007486843.1, 1 page.
GenBank Database (Dec. 9, 2016) "alpha-1,2-fucosyltransferase [Prevotella salivae]", GenBank Accession No. WP_007135533.1, 1 page.
GenBank Database (Dec. 9, 2016) "alpha-1,2-fucosyltransferase [Bacteroides dorei]", GenBank Accession No. WP_007842931.1, 1 page.
GenBank Database (Dec. 9, 2016) "alpha-1,2-fucosyltransferase [*Roseobacter* sp. SK209-2-6]", GenBank Accession No. WP_008210047.1, 1 page.
GenBank Database (Dec. 9, 2016) "alpha-1,2-fucosyltransferase [Alpha proteobacterium SCGC AAA076-003]", GenBank Accession No. WP_020056701.1, 1 page.
GenBank Database (Dec. 9, 2016) "alpha-1,2-fucosyltransferase [Helicobacter bilis]", GenBank Accession No. WP_004087499.1, 1 page.
GenBank Database (Dec. 9, 2016) "alpha-1,2-fucosyltransferase [*Cupriavidus* sp. GA3-3]", GenBank Accession No. WP_010813809.1, 1 page.
GenBank Database (Dec. 9, 2016) "alpha-1,2-fucosyltransferase [Bacteroides ovatus]", GenBank Accession No. WP_004303999.1, 1 page.
GenBank Database (Dec. 9, 2016) "alpha-1,2-fucosyltransferase [Yoonia vestfoldensis]", GenBank Accession No. WP_019955906.1, 1 page.
GenBank Database (Dec. 9, 2016) "alpha-1,2-fucosyltransferase [*Flavobacterium* sp. ACAM 123]", GenBank Accession No. WP_016991189.1, 1 page.
GenBank Database (Dec. 9, 2016) "alpha-1,2-fucosyltransferase [Bacteroides fragilis]", GenBank Accession No. WP_005779407.1, 1 page.
GenBank Database (Dec. 9, 2016) "alpha-1,2-fucosyltransferase [Spirosoma panaciterrae]", GenBank Accession No. WP_020598002.1, 1 page.
GenBank Database (Dec. 9, 2016) "alpha-1,2-fucosyltransferase [Colwellia piezophila]", GenBank Accession No. WP_019028421.1, 1 page.
GenBank Database (Dec. 9, 2016) "alpha-1,2-fucosyltransferase [Prevotella maculosa]", GenBank Accession No. WP_019966794.1, 1 page.
GenBank Database (Dec. 9, 2016) "alpha-1,2-fucosyltransferase [*Clostridium* sp. CAG:510]", GenBank Accession No. WP_022124550.1, 1 page.
GenBank Database (Dec. 9, 2016) "alpha-1,2-fucosyltransferase [Rhodopirellula europaea]", GenBank Accession No. WP_008665459.1, 1 page.
GenBank Database (Dec. 9, 2016) "alpha-1,2-fucosyltransferase [Bacillus cereus]", GenBank Accession No. WP_000587678.1, 1 page.
GenBank Database (Dec. 9, 2016) "alpha-1,2-fucosyltransferase [Firmicutes bacterium CAG:95]", GenBank Accession No. WP_022499937.1, 1 page.
GenBank Database (Dec. 9, 2016) "alpha-1,2-fucosyltransferase [Prevotella oris]", GenBank Accession No. WP_004374901.1, 1 page.
GenBank Database (Dec. 9, 2016) "alpha-1,2-fucosyltransferase [Desulfovibrio africanus]", GenBank Accession No. WP_005984173.1, 1 page.
GenBank Database (Dec. 9, 2016) "alpha-1,2-fucosyltransferase [Akkermansia muciniphila CAG:154]", GenBank Accession No. WP_022196965.1, 1 page.
GenBank Database (Dec. 9, 2016) "alpha-1,2-fucosyltransferase [Dysgonomonas mossii]", GenBank Accession No. WP_006843524.1, 1 page.
GenBank Database (Dec. 9, 2016) "alpha-1,2-fucosyltransferase [Prevotella oris]", GenBank Accession No. WP_004372410.1, 1 page.
GenBank Database (Dec. 9, 2016) "alpha-1,2-fucosyltransferase [Pseudogulbenkiania ferrooxidans]", GenBank Accession No. WP_008952440.1, 1 page.
GenBank Database (Dec. 9, 2016) "alpha-1,2-fucosyltransferase [*Salmonella enterica*]", GenBank Accession No. WP_000286641.1, 1 page.
GenBank Database (Dec. 9, 2016) "alpha-1,2-fucosyltransferase [*Prevotella* sp. CAG:1185]", GenBank Accession No. WP_021964668.1, 1 page.
GenBank Database (Dec. 9, 2016) "alpha-1,2-fucosyltransferase [*Selenomonas* sp. CM52]", GenBank Accession No. WP_009645343.1, 1 page.
GenBank Database (Dec. 9, 2016) "alpha-1,2-fucosyltransferase [Bacteroides nordii]", GenBank Accession No. WP_007486621.1, 1 page.
GenBank Database (Dec. 9, 2016) "alpha-1,2-fucosyltransferase [Parabacteroides merdae]", GenBank Accession No. WP_005635503.1, 1 page.

(56) References Cited

OTHER PUBLICATIONS

GenBank Database (Dec. 9, 2016) "alpha-1,2-fucosyltransferase [*Butyrivibrio* sp. NC2007]", GenBank Accession No. WP_022768139.1, 1 page.
GenBank Database (Dec. 9, 2016) "alpha-1,2-fucosyltransferase [Bacteroides ovatus]", GenBank Accession No. WP_004302233.1, 1 page.
GenBank Database (Dec. 9, 2016) "alpha-1,2-fucosyltransferase [*Clostridium* sp. KLE 1755]", GenBank Accession No. WP_021639228.1, 1 page.
GenBank Database (Dec. 9, 2016) "alpha-1,2-fucosyltransferase [Bacteroides plebeius CAG:211]", GenBank Accession No. WP_022052991.1, 1 page.
GenBank Database (Dec. 9, 2016) "alpha-1,2-fucosyltransferase [Treponema lecithinolyticum]", GenBank Accession No. WP_021686002.1, 1 page.
GenBank Database (Dec. 9, 2016) "alpha-1,2-fucosyltransferase [Bacteroides eggerthii]", GenBank Accession No. WP_004291980.1, 1 page.
GenBank Database (Dec. 9, 2016) "alpha-1,2-fucosyltransferase [Bacteroides stercoris]", GenBank Accession No. WP_005656005.1, 1 page.
GenBank Database (Dec. 9, 2016) "alpha-1,2-fucosyltransferase [*Roseobacter* sp. GAI101]", GenBank Accession No. WP_008228724.1, 1 page.
GenBank Database (Dec. 9, 2016) "alpha-1,2-fucosyltransferase [Prevotella oris]", GenBank Accession No. WP_004377401.1, 1 page.
GenBank Database (Dec. 9, 2016) "alpha-1,2-fucosyltransferase [Prevotella oulorum]", GenBank Accession No. WP_004380180.1, 1 page.
GenBank Database (Dec. 9, 2016) "alpha-1,2-fucosyltransferase [Spirosoma panaciterrae]", GenBank Accession No. WP_020596174.1, 1 page.
GenBank Database (Dec. 9, 2016) "alpha-1,2-fucosyltransferase [*Butyrivibrio* sp. XPD2006]", GenBank Accession No. WP_022765786.1, 1 page.
GenBank Database (Dec. 9, 2016) "alpha-1,2-fucosyltransferase [*Coraliomargarita* sp. CAG:312]", GenBank Accession No. WP_022477844.1, 1 page.
GenBank Database (Dec. 9, 2016) "alpha-1,2-fucosyltransferase [Pseudorhodobacter ferrugineus]", GenBank Accession No. WP_022705649.1, 1 page.
GenBank Database (Dec. 9, 2016) "alpha-1,2-fucosyltransferase [Anaeromusa acidaminophila]", GenBank Accession No. WP_018702959.1, 1 page.
GenBank Database (Dec. 9, 2016) "alpha-1,2-fucosyltransferase [Treponema bryantii]", GenBank Accession No. WP_022932606.1, 1 page.
GenBank Database (Dec. 9, 2016) "alpha-1,2-fucosyltransferase [Firmicutes bacterium CAG:534]", GenBank Accession No. WP_022352105.1, 1 page.
GenBank Database (Dec. 9, 2016) "alpha-1,2-fucosyltransferase [Firmicutes bacterium CAG:882]", GenBank Accession No. WP_022368748.1, 1 page.
GenBank Database (Dec. 9, 2016) "alpha-1,2-fucosyltransferase [Vibrio parahaemolyticus]", GenBank Accession No. WP_005496882.1, 1 page.
GenBank Database (Dec. 9, 2016) "alpha-1,2-fucosyltransferase [Herbaspirillum frisingense]", GenBank Accession No. WP_006463714.1, 1 page.
GenBank Database (Dec. 9, 2016) "alpha-1,2-fucosyltransferase [*Rhizobium* sp. CF080]", GenBank Accession No. WP_007759661.1, 1 page.
GenBank Database (Dec. 9, 2016) "alpha-1,2-fucosyltransferase [Verrucomicrobium spinosum]", GenBank Accession No. WP_009959380.1, 1 page.
GenBank Database (Dec. 9, 2016) "alpha-1,2-fucosyltransferase [*Rhodobacter* sp. CACIA14H1]", GenBank Accession No. WP_023665745.1, 1 page.
GenBank Database (Dec. 9, 2016) "alpha-1,2-fucosyltransferase [Spirosoma spitsbergense]", GenBank Accession No. WP_020604054.1, 1 page.
GenBank Database (Dec. 9, 2016) "alpha-1,2-fucosyltransferase [Prevotella micans]", GenBank Accession No. WP_006950883.1, 1 page.
GenBank Database (Dec. 9, 2016) "alpha-1,2-fucosyltransferase [Coleofasciculus chthonoplastes]", GenBank Accession No. WP_006100814.1, 1 page.
GenBank Database (Dec. 9, 2016) "alpha-1,2-fucosyltransferase [Bacteroides gallinarum]", GenBank Accession No. WP_018666797.1.
GenBank Database (Dec. 9, 2016) "alpha-1,2-fucosyltransferase [Firmicutes bacterium CAG:882]", GenBank Accession No. WP_022367483.1, 1 page.
GenBank Database (Dec. 9, 2016) "alpha-1,2-fucosyltransferase [Bacteroides xylanisolvens]", GenBank Accession No. WP_008021494.1, 1 page.
GenBank Database (Dec. 9, 2016) "alpha-1,2-fucosyltransferase [Lachnospiraceae bacterium 28-4]", GenBank Accession No. WP_016291997.1, 1 page.
GenBank Database (Dec. 9, 2016) "alpha-1,2-fucosyltransferase [*Prevotella* sp. CAG:1092]", GenBank Accession No. WP_021989703.1, 1 page.
GenBank Database (Dec. 9, 2016) "alpha-1,2-fucosyltransferase [Spirosoma luteum]", GenBank Accession No. WP_018618567.1, 1 page.
GenBank Database (Dec. 9, 2016) "alpha-1,2-fucosyltransferase [Candidatus pelagibacter ubique]", GenBank Accession No. WP_020169431.1, 1 page.
GenBank Database (Dec. 9, 2016) "alpha-1,2-fucosyltransferase [*Bacteroides* sp. CAG:875]", GenBank Accession No. WP_022353174.1, 1 page.
GenBank Database (Dec. 9, 2016) "alpha-1,2-fucosyltransferase [Butyrivibrio fibrisolvens]", GenBank Accession No. WP_022756327.1, 1 page.
GenBank Database (Dec. 9, 2016) "alpha-1,2-fucosyltransferase [Rhodopirellula europaea]", GenBank Accession No. WP_008659200.1, 1 page.
GenBank Database (Dec. 9, 2016) "alpha-1,2-fucosyltransferase [Rudanella lutea]", GenBank Accession No. WP_019988573.1, 1 page.
GenBank Database (Dec. 9, 2016) "alpha-1,2-fucosyltransferase [Paraprevotella clara]", GenBank Accession No. WP_008618094.1, 1 page.
GenBank Database (Dec. 9, 2016) "alpha-1,2-fucosyltransferase [Smaragdicoccus niigatensis]", GenBank Accession No. WP_018159152.1, 1 page.
GenBank Database (Dec. 9, 2016) "alpha-1,2-fucosyltransferase [Bacteroides fragilis CAG:558]", GenBank Accession No. WP_022012576.1, 1 page.
GenBank Database (Dec. 9, 2016) "alpha-1,2-fucosyltransferase [Desulfovibrio desulfuricans]", GenBank Accession No. WP_022657592.1, 1 page.
GenBank Database (Dec. 9, 2016) "alpha-1,2-fucosyltransferase [Hoeflea phototrophica]", GenBank Accession No. WP_007199917.1, 1 page.
GenBank Database (Dec. 9, 2016) "alpha-1,2-fucosyltransferase [Lachnospiraceae bacterium NK4A179]", GenBank Accession No. WP_022784718.1, 1 page.
GenBank Database (Dec. 9, 2016) "alpha-1,2-fucosyltransferase [Cecembia lonarensis]", GenBank Accession No. WP_009185692.1, 1 page.
GenBank Database (Dec. 9, 2016) "alpha-1,2-fucosyltransferase [Bacteroides coprocola CAG:162]", GenBank Accession No. WP_022125287.1, 1 page.
GenBank Database (Dec. 9, 2016) "alpha-1,2-fucosyltransferase [Bacteroides intestinalis]", GenBank Accession No. WP_007662951.1, 1 page.
GenBank Database (Dec. 9, 2016) "alpha-1,2-fucosyltransferase [Lachnospiraceae bacterium A4]", GenBank Accession No. WP_016283022.1, 1 page.

(56) References Cited

OTHER PUBLICATIONS

GenBank Database (Dec. 9, 2016) "alpha-1,2-fucosyltransferase [Prevotella pleuritidis]", GenBank Accession No. WP_021584236.1, 1 page.
GenBank Database (Dec. 9, 2016) "alpha-1,2-fucosyltransferase [*Bacteroides sp.* 1_1_14]", GenBank Accession No. WP_008763191.1, 1 page.
GenBank Database (Dec. 9, 2016) "alpha-1,2-fucosyltransferase [Agromyces subbeticus]", GenBank Accession No. WP_022893737.1, 1 page.
GenBank Database (Dec. 9, 2016) "alpha-1,2-fucosyltransferase [Prevotella salivae]", GenBank Accession No. WP_007133870.1, 1 page.
GenBank Database (Dec. 9, 2016) "alpha-1,2-fucosyltransferase [Paraprevotella xylaniphila]", GenBank Accession No. WP_008626629.1, 1 page.
GenBank Database (Dec. 9, 2016) "alpha-1,2-fucosyltransferase [*Thauera* sp. 28]", GenBank Accession No. WP_002930798.1, 1 page.
GenBank Database (Dec. 9, 2016) "alpha-1,2-fucosyltransferase [Subdoligranulum variabile]", GenBank Accession No. WP_007048308.1, 1 page.
GenBank Database (Dec. 9, 2016) "alpha-1,2-fucosyltransferase [Firmicutes bacterium CAG:24]", GenBank Accession No. WP_021916223.1, 1 page.
GenBank Database (Dec. 9, 2016) "alpha-1,2-fucosyltransferase [*Prevotella* sp. CAG:474]", GenBank Accession No. WP_022310139.1, 1 page.
GenBank Database (Dec. 9, 2016) "alpha-1,2-fucosyltransferase [Roseburia intestinalis]", GenBank Accession No. WP_006855899.1, 1 page.
GenBank Database (Dec. 9, 2016) "alpha-1,2-fucosyltransferase [*Butyrivibrio* sp. AE3009]", GenBank Accession No. WP_022779599.1, 1 page.
GenBank Database (Dec. 9, 2016) "alpha-1,2-fucosyltransferase [Prevotella nanceiensis]", GenBank Accession No. WP_018362656.1, 1 page.
GenBank Database (Dec. 9, 2016) "alpha-1,2-fucosyltransferase [Winogradskyella psychrotolerans]", GenBank Accession No. WP_020895733.1, 1 page.
GenBank Database (Dec. 9, 2016) "alpha-1,2-fucosyltransferase [Lachnospiraceae bacterium NK4A179]", GenBank Accession No. WP_022785342.1, 1 page.
GenBank Database (Dec. 9, 2016) "alpha-1,2-fucosyltransferase [*Prevotella* sp. oral taxon 317]", GenBank Accession No. WP_009230832.1, 1 page.
GenBank Database (Dec. 9, 2016) "alpha-1,2-fucosyltransferase [*Butyrivibrio* sp. XPD2006]", GenBank Accession No. WP_022765796.1, 1 page.
GenBank Database (Dec. 9, 2016) "alpha-1,2-fucosyltransferase [Butyrivibrio fibrisolvens]", GenBank Accession No. WP_022752717.1, 1 page.
GenBank Database (Dec. 9, 2016) "alpha-1,2-fucosyltransferase [Cylindrospermopsis raciborskii]", GenBank Accession No. WP_006278973.1, 1 page.
GenBank Database (Dec. 9, 2016) "alpha-1,2-fucosyltransferase [Prevotella multiformis]", GenBank Accession No. WP_007368154.1, 1 page.
GenBank Database (Dec. 9, 2016) "alpha-1,2-fucosyltransferase [*Bacteroides* sp. CAG:462]", GenBank Accession No. WP_022384635.1, 1 page.
GenBank Database (Dec. 9, 2016) "alpha-1,2-fucosyltransferase [*Roseburia* sp. CAG:100]", GenBank Accession No. WP_022518697.1, 1 page.
GenBank Database (Dec. 9, 2016) "alpha-1,2-fucosyltransferase [Lachnospiraceae bacterium 10-1]", GenBank Accession No. WP_022742385.1, 1 page.
GenBank Database (Dec. 9, 2016) "alpha-1,2-fucosyltransferase [Prevotella nigrescens]", GenBank Accession No. WP_004362670.1, 1 page.
GenBank Database (Dec. 9, 2016) "alpha-1,2-fucosyltransferase [*Bacteroides* sp. CAG:875]", GenBank Accession No. WP_022353235.1, 1 page.
GenBank Database (Dec. 9, 2016) "alpha-1,2-fucosyltransferase [Paraprevotella xylaniphila]", GenBank Accession No. WP_008628783.1, 1 page.
GenBank Database (Dec. 9, 2016) "alpha-1,2-fucosyltransferase [Dethiosulfovibrio peptidovorans]", GenBank Accession No. WP_005658864.1, 1 page.
GenBank Database (Dec. 9, 2016) "alpha-1,2-fucosyltransferase [Lachnospiraceae bacterium 10-1]", GenBank Accession No. WP_016229292.1, 1 page.
GenBank Database (Dec. 9, 2016) "alpha-1,2-fucosyltransferase [Treponema maltophilum]", GenBank Accession No. WP_016525279.1, 1 page.
GenBank Database (Dec. 9, 2016) "alpha-1,2-fucosyltransferase [Lachnospiraceae bacterium NK4A136]", GenBank Accession No. WP_022780989.1, 1 page.
GenBank Database (Dec. 9, 2016) "alpha-1,2-fucosyltransferase [Bacteroides coprophilus]", GenBank Accession No. WP_008144634.1, 1 page.
GenBank Database (Dec. 9, 2016) "alpha-1,2-fucosyltransferase [Paraprevotella clara]", GenBank Accession No. WP_008619736.1, 1 page.
GenBank Database (Dec. 9, 2016) "alpha-1,2-fucosyltransferase [*Butyrivibrio* sp. NC2007]", GenBank Accession No. WP_022770361.1, 1 page.
GenBank Database (Dec. 9, 2016) "alpha-1,2-fucosyltransferase [Paraprevotella xylaniphila]", GenBank Accession No. WP_008628536.1, 1 page.
GenBank Database (Dec. 9, 2016) "alpha-1,2-fucosyltransferase [Blautia hydrogenotrophica]", GenBank Accession No. WP_005944761.1, 1 page.
GenBank Database (Dec. 9, 2016) "alpha-1,2-fucosyltransferase [Lachnospiraceae bacterium NK4A136]", GenBank Accession No. WP_022781176.1, 1 page.
GenBank Database (Dec. 9, 2016) "alpha-1,2-fucosyltransferase [Bacteroides vulgatus]", GenBank Accession No. WP_005840359.1, 1 page.
GenBank Database (Dec. 9, 2016) "alpha-1,2-fucosyltransferase [*Butyrivibrio* sp. AE2015]", GenBank Accession No. WP_022772730.1, 1 page.
GenBank Database (Dec. 9, 2016) "alpha-1,2-fucosyltransferase [Roseovarius nubinhibens]", GenBank Accession No. WP_009813856.1, 1 page.
GenBank Database (Dec. 9, 2016) "alpha-1,2-fucosyltransferase [*Eubacterium* sp. CAG:581]", GenBank Accession No. WP_022505071.1, 1 page.
GenBank Database (Dec. 9, 2016) "alpha-1,2-fucosyltransferase [*Prevotella* sp. oral taxon 472]", GenBank Accession No. WP_009236633.1, 1 page.
GenBank Database (Dec. 9, 2016) "alpha-1,2-fucosyltransferase [Butyrivibrio fibrisolvens]", GenBank Accession No. WP_022752732.1, 1 page.
GenBank Database (Dec. 9, 2016) "Multispecies: alpha-1,2-fucosyltransferase [Butyrivibrio]", GenBank Accession No. WP_022762282.1, 1 page.
GenBank Database (Dec. 9, 2016) "Multispecies: alpha-1,2-fucosyltransferase [Parabacteroides]", GenBank Accession No. WP_005867692.1, 1 page.
GenBank Database (Dec. 9, 2016) "Multispecies: alpha-1,2-fucosyltransferase [Clostridiales]", GenBank Accession No. WP_016359991.1, 1 page.
GenBank Database (Dec. 9, 2016) "Multispecies: alpha-1,2-fucosyltransferase [Bacteroides]", GenBank Accession No. WP_005839979.1, 1 page.
GenBank Database (Dec. 9, 2016) "Multispecies: alpha-1,2-fucosyltransferase [Butyrivibrio]", GenBank Accession No. WP_022762290.1, 1 page.
GenBank Database (Dec. 9, 2016) "Multispecies: alpha-1,2-fucosyltransferase [Rhodobacteraceae]", GenBank Accession No. WP_008562971.1, 1 page.

(56) References Cited

OTHER PUBLICATIONS

GenBank Database (Dec. 9, 2016) "Multispecies: alpha-1,2-fucosyltransferase [Bacteroides]", GenBank Accession No. WP_004313284.1, 1 page.
GenBank Database (Apr. 19, 2017) "Multispecies: alpha-1,2-fucosyltransferase [Clostridiales]", GenBank Accession No. WP_009251343.1, 1 page.
GenBank Database (Jul. 20, 2017) "alpha-1,2-fucosyltransferase [Lewinella persica]", GenBank Accession No. WP_020571066.1, 1 page.
GenBank Database (Jul. 20, 2017) "alpha-1,2-fucosyltransferase [Methylophilus methylotrophus]", GenBank Accession No. WP_018985060.1, 1 page.
GenBank Database (Jul. 22, 2017) "alpha-1,2-fucosyltransferase [Bacteroides sartorii]", GenBank Accession No. WP_016276676.1, 1 page.
Genbank Database (Jul. 27, 2017) "alpha-1,2-fucosyltransferase [Bacteroides fragilis YCH46]", GenBank Accession No. YP_099857.1, 2 pages.
GenBank Database (Jul. 27, 2017) "putative alpha-1,2-fucosyltransferase [Bacteroides fragilis YCH46]", GenBank Accession No. YP_099118.1, 2 pages.
GenBank Database (Aug. 18, 2017) "Multispecies: alpha-1,2-fucosyltransferase [Parabacteroides]", GenBank Accession No. WP_005857874.1, 1 page.
GenBank Database (Jan. 12, 2018) "alpha-1,2-fucosyltransferase [Litoreibacter arenae]", GenBank Accession No. WP_021099615.1, 1 page.
GenBank Database (Mar. 2, 2018) "Multispecies: alpha-1,2-fucosyltransferase [Helicobacter]", GenBank Accession No. WP_005219731.1, 1 page.
GenBank Database (Mar. 9, 2018) "Multispecies: alpha-1,2-fucosyltransferase [*Escherichia*]", GenBank Accession No. WP_021554465.1, 1 page.
GenBank Database (Apr. 5, 2018) "Multispecies: alpha-1,2-fucosyltransferase [Bacteroides] ", GenBank Accession No. WP_008659600.1, 1 page.
GenBank Database (May 2, 2018) "alpha-1,2-fucosyltransferase [Bacteroides thetaiotaomicron]", GenBank Accession No. WP_008766093.1, 1 page.
GenBank Database (May 2, 2018) "alpha-1,2-fucosyltransferase [Bacteroides fragilis]", GenBank Accession No. WP_008768986.1, 1 page.
GenBank Database (May 2, 2018) "alpha-1,2-fucosyltransferase [Bacteroides fragilis]", GenBank Accession No. WP_008768245.1, 1 page.
GenBank Database (Jun. 3, 2018) "glycosyltransferase [Butyrivibrio fibrisolvens]", GenBank Accession No. WP_022755397.1, 1 page.
GenBank Database (Jun. 3, 2018) "glycosyltransferase [Firmicutes bacterium CAG:791] ", GenBank Accession No. WP_021849028.1, 1 page.
GenBank Database (Jun. 3, 2018) "glycosyltransferase [Leeia oryzae] ", GenBank Accession No. WP_018150480.1, 2 pages.
GenBank Database (Aug. 13, 2018) "glycosyltransferase family 11 [Synechococcus phage S-SM2]", GenBank Accession No. YP_004322362.1, 2 pages.
GenBank Database (Sep. 4, 2018) "Multispecies: alpha-1,2-fucosyltransferase [Bacteroides]", GenBank Accession No. WP_008671843.1, 1 page.
GenBank Database (Sep. 5, 2018) "Multispecies: alpha-1,2-fucosyltransferase [Clostridiales]", GenBank Accession No. WP_021636935.1, 1 page.
GenBank Database (Sep. 6, 2018) "Multispecies: alpha-1,2-fucosyltransferase [Bacteroides]", GenBank Accession No. WP_007835585.1, 1 page.
GenBank Database (Sep. 9, 2018) "Multispecies: alpha-1,2-fucosyltransferase [Bacteroides]", GenBank Accession No. WP_004295547.1, 1 page.
GenBank Database (Nov. 9, 2018) "alpha-1,2-fucosyltransferase [Pseudoalteromonas distincta]", GenBank Accession No. WP_002958454.1, 1 page.
GenBank Database (Jan. 19, 2019) "Multispecies: alpha-1,2-fucosyltransferase [Bacteroides]", GenBank Accession No. WP_004296622.1, 1 page.
GenBank (Dec. 11, 2013) "Glycosyl Transferase Family 11 [Akkermansia muciniphila ATCC BAA-835]", Accession No. ACD04774.1, 1 page.
GenBank (May 31, 2013) "Glycosyl Transferase Family 11 [*Tannerella* Sp. CAG:118]", Accession No. CCY38847.1, 1 page.
GenBank (May 31, 2013) "Glycosyltransferase Family 11 [*Bacteroides* Sp. CAG:633]", Accession No. CDB11986.1, 1 page.
GenBank (Apr. 19, 2013) "Hypothetical Protein HMPREF1097_05434 [[Clostridium] Bolteae 90B8]", Accsession No. ENZ32021.1, 2 pages.
GenBank (May 31, 2013) "Uncharacterized Protein BN805_01914 [*Prevotella* Sp. CAG:891]", Accession No. CDE87265.1, 1 page.
Kobata et al. (1978) "Oligosaccharides from Human Milk", Methods in Enzymology, 50:216-220.
Uniprot (Apr. 16, 2014) "Akkermans is Muciniphila (Strain ATCC BAA-835)", Uniprot Accession No. B2UQN9, 1 page.
Uniprot (Apr. 16, 2014) "Bacteroides caccae ATCC 43185.", Uniprot Accession No. A5ZC72, 1 page.
Uniprot (Apr. 16, 2014) "*Bacteroides* sp. CAG:633.", Uniprot Accession No. R6FSMO, 1 page.
Uniprot (Apr. 16, 2014) "Clostridium bolteae 9068", Uniprot Accession No. N9YWN5, 1 page.
Uniprot, "Lachnospiraceae Bacterium 3_1_57FAA_CT1.", Uniprot Accession No. F7K6A6, 1 page.
Uniprot (Apr. 16, 2014) "Parabacteroides Johnsonii CL02T12C29.", Uniprot Accession No. K5YCP4, 1 page.
Uniprot (Apr. 16, 2014) "*Prevotella* sp. CAG:891.", Uniprot Accession No. R7LF73, 1 page.
Uniprot (Apr. 16, 2014) "*Tannerella* sp. CAG:118.", Uniprot Accession No. R5IPH9, 1 page.
Uniprot (Apr. 16, 2014), Accession No. B8GDY9 "Methanosphaerula palustris (strain ATCC BAA-1556 / DSM 199581 E1-9c)." Uniprot Accession No. B8GDY9, 1 page.

* cited by examiner

|  |  | 1 | 2 | 3 | 4 |
|---|---|---|---|---|---|
| H.pylori futC | 1 |  | 70.10 | 23.97 | 22.57 |
| H.mustelae futL | 2 | 70.10 |  | 27.04 | 21.36 |
| Bacteroides vulgatus futN | 3 | 23.97 | 27.04 |  | 31.23 |
| E. coli O126 wbgL | 4 | 22.57 | 21.36 | 31.23 |  |

| FIG. 4A | FIG. 4B |
|---|---|
| FIG. 4C | FIG. 4D |
| FIG. 4E | FIG. 4F |

```
H.pylori futC                                    MAFKVVQICGGLGNQMFQYAFAKSLQKHSNTP--VLLDITSFDWSDR--
H.mustelae futL                                  MDFKIVQVHGGLGNQMFQYAFAKSLQTHLNIP--VLLDTTWFDYGNR--
Bacteroides vulgatus futN                        M--RLIKVTGGLGNQMFIYAFYLRMKKYY---PKVRIDLSDMMH-----
E. coli 0126 wbgL                                M--SIIRLQGGLGNQLFQFSFGYALSKINGTP--LYFDISHYAEN----
Prevotella melaninogenica FutO YP_003814512.1    M-K-IVKILGGLGNQMFQYALYLSLQES-FPKERVALDLSSF-------
Clostridium bolteae+13 FutP WP_002570768.1       m-v-iikmmggIgnqMFQYALYKAFEQK-HID--VYADLAWYKNKSV
Lachnospiraceae sp. FutQ WP_009251343.1          M-V-IVQLSGGLGNQMFEYALYLSLKAK-GKEVKID-DVTCYEGPGT
Methanosphaerula palustris FutR YP_002467213.1   M-I--IVRLKGGLGNQLSQYALGRKIAHL-HNTE-LKLDTTWFTTISS
Tannerella sp. FutS WP_021929367.1               M-VRIVEIIGGLGNQMFQYAFSLYLKNKSHIWDRLYVDIEAMKT----
Bacteroides caccae FutU WP_005675707.1           M-K-IVKILGGLGNQMFQYALFLSLKER-FPHEQVMIDTSCF------
Butyrivibrio FutV WP_022772718.1                 M-I--IIQLKGGLGNQMFQYALYKSLKKR-GKEVKID-DKTGFVNDKL
Prevotella sp. FutW WP_022481266.1               M--RLVKMIKMIGGLGNQMFIYAFYLQMRKRP---SNVRIDLTDMMH--
Parabacteroides johnsonii FutX WP_008155883.1    M--RLIKMIGGLGNQMFIYAFYLKMKHHY---PDTNIDLSDMVH----
Akkermansia muciniphila FutY YP_001877555        M----RLFGGLGNQLFQYAFLFALSRQGG--KARLETSSYEHDDK
Salmonella enterica FutZ WP_023214330            M-YSC--LSGGLGNQMFQYAAAYILKQYFQSTTLVLDDSYYSQPKR
Bacteroides sp. FutZA WP_022161880.1|            M--RLIKMTGGLGNQMFIYAFYLRMKKRY--PKVRIDLSDMVH----
Clostridium bolteae FutP WP_002570768.1          M------------FQYALYKAFEQK-HID--VYADLAWYKNKSV
```

FIG. 4A

```
KMQL------ELFPIDLPYASAKEIAIAKMQHLPKLVRDALKCM---------GFDRVSQEIVF 94
ELGL------HLFPIDLQCASAQQIAAAHMQNLPRLVRGALRRM---------GLGRVSKEIVF 94
---YKVHYGYEMHRVFNLPH------TEFCINQPLKKVIEFLF-FKKIY-----ERKQAPN 85
---DDHGGYRLNNL------QIPEEYLQYYTPKINNIYKFLVRGSRLYPEIFLPLGFCNEFHAY 96
---HGYHLHNGFELENIFSVTAQKASAADIMRIAYYYPNYLLWRIGKRFLPRRKGM-------CLESSSL 99
---KFELYN-----FGIKINVASEKDINRLSDCQADF-VSRIRRKIFGKKKSF--------VSEKNDS 93
RPR-------QLDVFGITYDRASREELTEMTDASMD-ALSRVRRKLTG-RRTK---------AYRERDI 94
DTPRTYRLNN---YNIIGTIASAKEIQLIERGRAQGRGYLLSKISDLLTPMYRRT--------YVRERMH 102
---YDRHYGLELEKVFNLSLCPISNRLHRNLQ------KRSFAKHFVKS---------LYEHSEC 90
---RNYPLHNGFEVDRIFAQKAPVASWRNILKVAYPYPNYRFWKIGKYILPKRKTM--------CVERKNF 99
RIP-------VLSRWGVEYDRATDEEIINLTDSKMD-LFSRIRRKLTG-RKTF---------RIDEESG 94
---YNVHYGYELHKVFGLPR------TEFCMNQPLKKVLEFLF-FRTIV-----ERKQH-G 84
---YKVHNGYEMNRIFDLSQ------TEFCINRTLKKILEFLF-FKKIY-----ERRQDPS 85
RVC---ELHHFRVSLPIEGGPPPWA------FRKSRIPACLRSLFAAPKYPH----FREEKRH 89
DTVRSLELNG----FNISYDRFSFAD------EKEKIKLLRKFKRNPFFPKQISEIDSIALPGKYALSDRA 104
---YHVHHGYEMHRVFNLPH------TEFCINQPLKKVIEFLF-FKKIY-----ERKQDPN 85
---KFELYN-----FGIKINVASEKDINRLSDCQADF-VSRIRRKIFGKKKSF--------VSEKNDS 80
```

FIG. 4B

| | | |
|---|---|---|
| H.pylori futC | EYEPKLLKPSR-LTYFFGYFQDPRYF--DAISPLIKQTFTLPPPPEN |
| H.mustelae futL | EYMPELFEPSR-IAYFHGYFQDPRYF--EDISPLIKQTFTLPHPTEH |
| Bacteroides vulgatus futN | SLRAFEKKYFWPLLYFKGFYQSERFF--ADIKDEVRESFTF----DK |
| E. coli O126 wbgL | GYDFEYIAQKWKSKKYIGYWQSEHFFHKHIL--DLKEFFI-----P |
| Prevotella melaninogenica FutO YP_003814512.1 | RFDESVLR-QEGNRYFDGYWQDERYF--AAYREKVLKAFTFPAFKRA |
| Clostridium bolteae+13 FutP WP_002570768.1 | CYENDILR-M-DNVYLSGYWQTEKYF--SNTREKLLEDYSF-ALVNS |
| Lachnospiraceae sp. FutQ WP_009251343.1 | NFDPLVME--KDPALLEGCFQSDKYF--RDCEGRVREAYRFRGIESG |
| Methanosphaerula palustris FutR YP_002467213.1 | TFDKAILT-VPDNVYLDGYWQTEKYF--KDIEEILRREVTLKDEPDS |
| Tannerella sp. FutS WP_021929367.1 | EFDEPVYRGLRPYRYYRGYWQNEGYFV--DIEPMIREAFQFNVNILS |
| Bacteroides caccae FutU WP_005675707.1 | SFDAAVLT-RKGDCYYDGYWQHEEYF--CDMKETIWEAFSFPEPVDG |
| Butyrivibrio FutV WP_022772718.1 | KFNPEILE--KENAYLVGYWQCDKYFDDKDVVREIREAFEKKPQE-- |
| Prevotella sp. FutW WP_022481266.1 | RMEPYTCQYVWPLVYFKGFYQSERYF--SEVKDEVRECFTF----NP |
| Parabacteroides johnsonii FutX WP_081155883.1 | TLYPYEKRYFWPLLYFKGFYQSERFF--FDIKDDVRKAFSF----NL |
| Akkermansia muciniphila FutY YP_001877555 | GFDPGLAAPPRRHTYFKGYFQTEQYFL--HCREQLCREFRLKTPLTP |
| Salmonella enterica FutZ WP_023214330 | FYTFETIKNIDKACLFSFYQDAD---LLNKYKQLILPLFELR---DD |
| Bacteroides sp. FutZA WP_022161880.1| | SLRAFEKKYLWPLLYFKGFYQSERFF--ADIKDEVRKAFTF----DS |
| Clostridium bolteae FutP WP_002570768.1 | CYENDILR-M-DNVYLSGYWQTEKYF--SNTREKLLEDYSF-ALVNS |

FIG. 4C

```
NKNNNKKEEEYQCKLSLILAAKNSVFVHIRRGDYVG------IGCQLGIDYQKKALEYMAKRV-----P  196
-----AEQYSRKLSQILAAKNSVFVHIRRGDYMR------LGWQLDISYQLRAIAYMAKRV-----Q  189
NK----ANSRSLNMLEILDKDENAVSLHIRRGDYLQ-PKHWATTGSVCQLPYYQNAIAEMSRRV----AS  187
KN----VSEQANLLAAKILESQSSLSIHIRRGDYIK-NKTATLTHGVCSLEYYKKALNKIRDLAMI----   196
EN----L---SLL-----EKLDENSIALHVRRGDYVG-NNL---YQGICDLDYYRTAIEKMCAHV----TP  194
QV----SEWEDSI----R--NKNSVSIHIRRGDYLQ-GEL---YGGICTSLYYAEAIEYIKMRV----   187
AF----PLPEDYLRLEKQIEDCQSVSVHIRRGDYLD-ESHGGLYTGICTEAYYKEAFARMERLV----PG  198
IN----LEMAERI-----QAC--HSVSLHVRRGDYVS-NPTTQQFHGCCSIDYYNRAISLIEEKV----DD  201
KK----TKAIAS------KMRRELSVSIHVRRGDYEN-PEAKAMHGGICSLDYYHKAIDFIRQRL----DN  192
RN----KEIGALL----QASD--SASLHVRRGDYVN-HPL---FRGICDLDYYKRAIHYMEERV----NP  195
LM----TDASSWSTLQ-QIECCESVSLHVRRTDYVD-EEHIHIHN-ICTEKYYKNAIDRVRKQY----PS  196
AL----ANRSSQQMMEQIQNDPQAVSIHIRRGDYLN-PKHYDTIGCICQLPYYKHAVSEIKKYV----SN  186
NI----ANPFSLFLLKQIEVDDQAVSIHIRRGDYLL-PRHWANTGSVCOLPYYKNAIAEMENRI----TG  187
EN----ARILEDI-----RSCCSISLHIRRTDYLSNP-----YLSPPPLEYYLRSMAEMEGRLRAAGAPQE  191
LL----DICKNLELYSLIQRSNNTTALHIRRGDYVT-NQHAAKYHGVLDISYYNHAMEYVERE-----RG  205
SK----VNARSAELLRRLDADANAVSLHIRRGDYLQ-PQHWATTGSVCQLPYYQNAIAEMNRRV----AA  187
QV----SEWEDSI----R--NKNSVSIHIRRGDYLQ-GEL---YGGICTSLYYAEAIEYIKMRV----PN  174
```

FIG. 4D

| | |
|---|---|
| H.pylori futC | NMELFVFCEDLEFT-QNLDLGYP---FMDMTTRDKEFEAYWDMLLMG |
| H.mustelae futL | NLELFLFCEDLEFV-QNLDLGYP---FVDMTTRDGA--AHWDMMLMQ |
| Bacteroides vulgatus futN | PS-YYIFSDDIAWVKENL----PLQNAVYIDWNTDE-DSWQDMMLMS |
| E. coli 0126 wbgL | -RDVFIFSDDIFWCKENIETLLSKKYNIYYSEDLSQEE---DLWLMS |
| Prevotella melaninogenica FutO YP_003814512.1 | SL-FCIFSNDITWCQQHLQPYLKAP-VVYVTWNTGV-ESYRDMQLMS |
| Clostridium bolteae+13 FutP WP_002570768.1 | AK-FFVFSDDVEWVKQQED----FKGFVIVDRNEYS-SALSDMYLMS |
| Lachnospiraceae sp. FutQ WP_009251343.1 | AR-FFLFSNDPEWTREHFE----SKNCVLVEGSTED-TGYMDLYLMS |
| Methanosphaerula palustris FutR YP_002467213.1 | PS-FFIFSDDLPWAKENLD---IPGEKT-FVAHNGPE-KEYCDLWLMS |
| Tannerella sp. FutS WP_021929367.1 | NICFYLFSDDINWVEENLQL---ENRCIIDWNQGE-DSWQDMYLMS |
| Bacteroides caccae FutU WP_005675707.1 | QL-YCVFSNDMAWCESHLRALLPGKEVVYVDWNKGA-ESYVDMRLMS |
| Butyrivibrio FutV WP_022772718.1 | AV-FFIFTDDKEWCRDHFK----GPNFIVVELEEGDGTDIAEMRLMS |
| Prevotella sp. FutW WP_022481266.1 | PH-FYVFSEDLDWVKANL----PLENAQYIDWNKGA-DSWQDMMLMS |
| Parabacteroides johnsonii FutX WP_008155883.1 | PS-YYVFSDDISWVKENI----PLKKAVYVTWNKGE-DSWQDMMLMS |
| Akkermansia muciniphila FutY YP_001877555 | SLRYFIFSDDIEWARQNLRPALP---HVHVDINDG-GTGYFDLELMR |
| Salmonella enterica FutZ WP_023214330 | KQNFIIFSDDVRWAQKAFLE----NDNCYVINNSDYDFSAIDMYLMS |
| Bacteroides sp. FutZA WP_022161880.1| | PS-YYVFSDDIAWVKENI----PLQNAVYIDWNKGE-ESWQDMMLMS |
| Clostridium bolteae FutP WP_002570768.1 | AK-FFVFSDDVEWVKQQED----FKGFVIVDRNEYS-SALSDMYLMS |

FIG. 4E

```
SCQHGI IANSTYSWWAAYLIENPEKI I IGPKHWLFGHFNIL--------CKEWVKIFSHFEVKSQKVNA---   301
SCKHGI ITNSTYSWWAAYLIKNPEKI I IGPSHWIYGNENIL--------CKDWVKIESQFETKS*-------   287
HCKHHI ICNSTFSWWGAWLNPNMDKTVIVPSRWFQ----HSEAPDIYPT--GWIKV--PVS*----------   282
LANHHI IANSSFSWWGAYLGTSASQIVIYPTPWYDITPKNTY----IPIVNHWINVDKHSSC*----------   298
CCAHNI IANSSFSWWGAWLNQNREKVVIAPKKWLN--MEECHFTLPA--S----W--I----KI--------   288
LCKHNI IANSSFSWWAAWLNRNEEKIVIAPRRWLNGKCT------PDIWCK--KW--I----RI--------   278
RCRHNI IANSSFSWWGAWLNENPEKKVIAPAKWLNGR------ECRDIYTE--RW--I----RL--------   289
LCQHHI IANSSFSWWGAWLGQDAEKMVIAPRRWALSESFDTSDIIPD--S----W--I----TI--------   295
CCRHHI IANSSFSWWAAWLNPNKNKIVLTPNKWFN------HTDAVGIVPK--SWIKI---PVF--------   287
LCRHNI IANSSFSWWGAWLNRNPQKVVVAPERWMNSPIED----PV--SD--KW--I----KL--------   289
RCKHHI IANSSFSWWAAWLNDSPEKIVIAPQKWINNR------DMDDIYTE--RWTKI---AL--------   290
CCKHHI ICNSTFSWWAAWLNPSVEKTVIMPEQWTS------RQDSVDFVASCGRWVRV--KTE--------   282
HCRHHI ICNSTFSWWGAWLNPRKEKIVIAPCRWFQ----HKETPDMYPK--EWIKV--PIN----------   281
NCRHHI IANSTFSWWAAWLNEHAEKIVIAPRIWFNREEGDRYHTDDALIP--GSWLRI--------------   290
LCKNNI IANSTYSWWGAWLNKYEDKLVISPKQWFLGNNETS------LRNASWITL---------------   298
HCRHHI ICNSTFSWWGAWLDPHEDKIVIVPNRWFQ----HCETPNIYPA--GWVKV--AIN----------   281
LCKHNI IANSSFSWWAAWLNRNEEKIVIAPRRWLNGKCT------PDIWCK--KW--I----RI--------   265
```

FIG. 4F

Post-Gibson assembly PCR

Gel-purified RI/XhoI syngene fragment

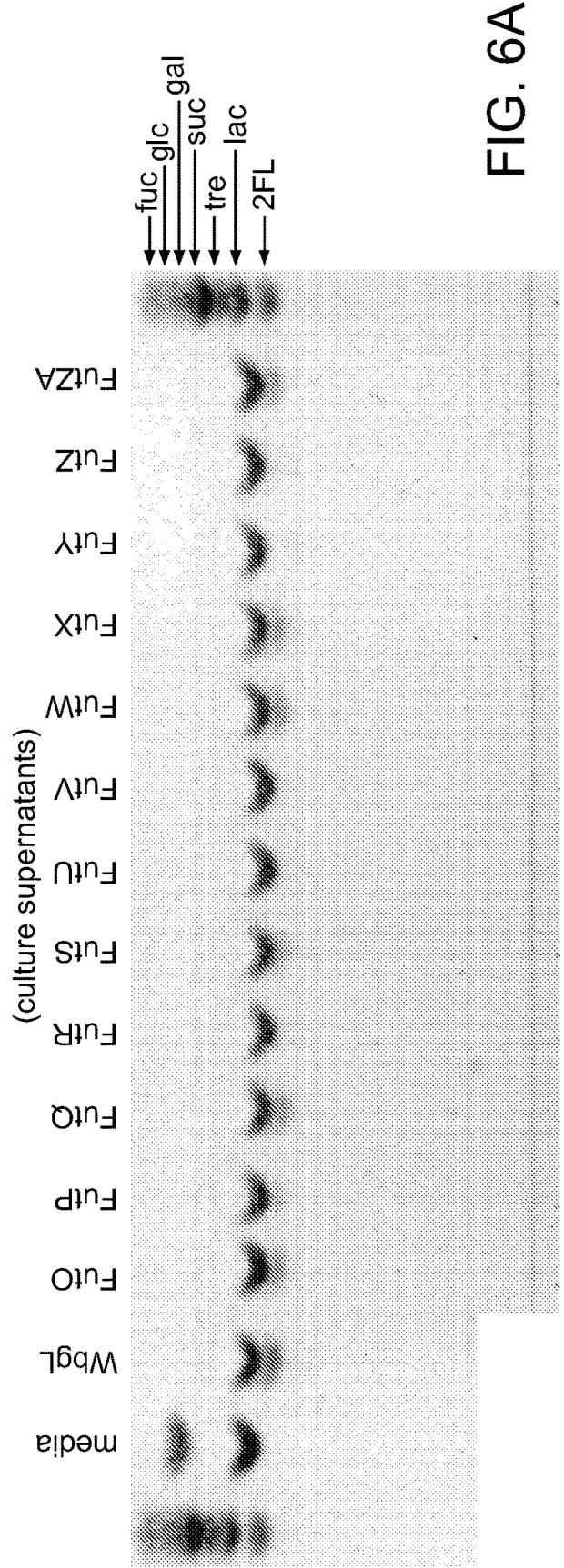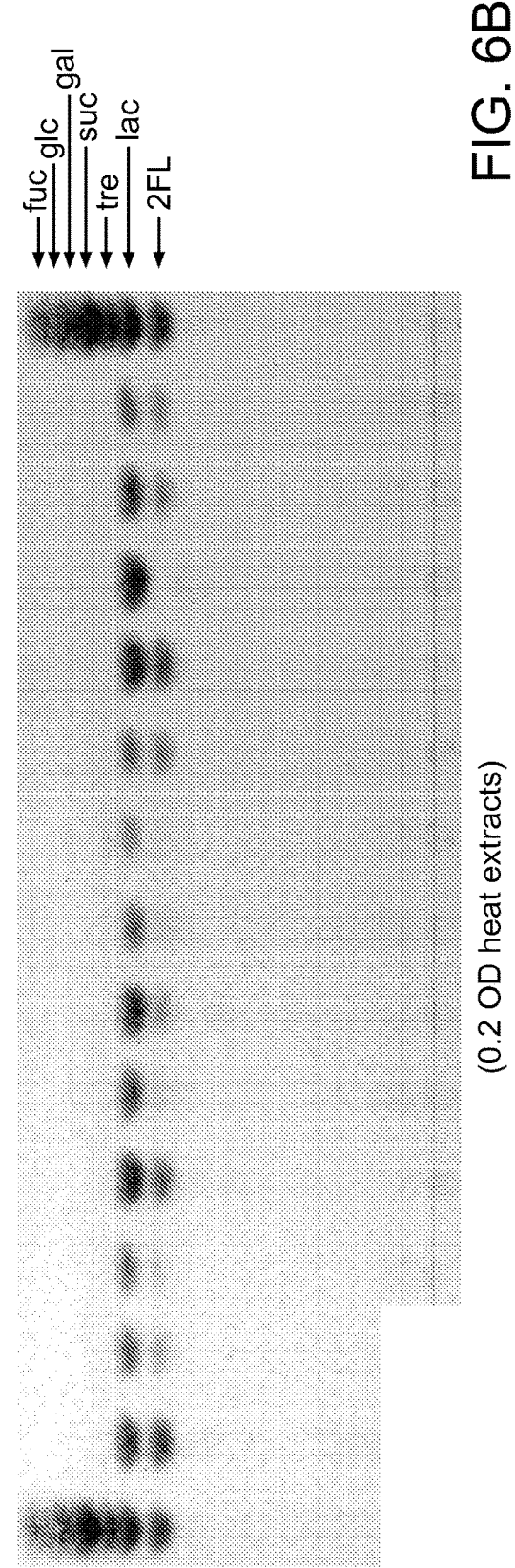

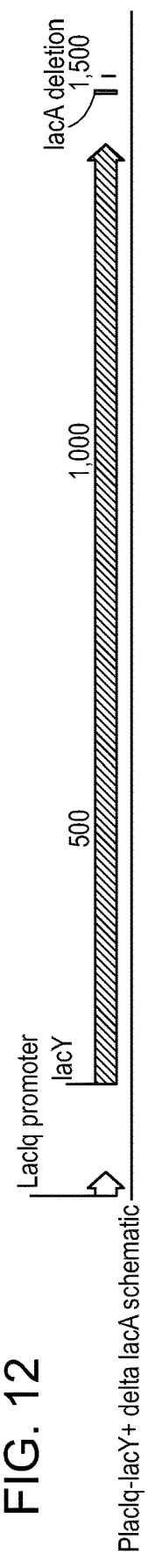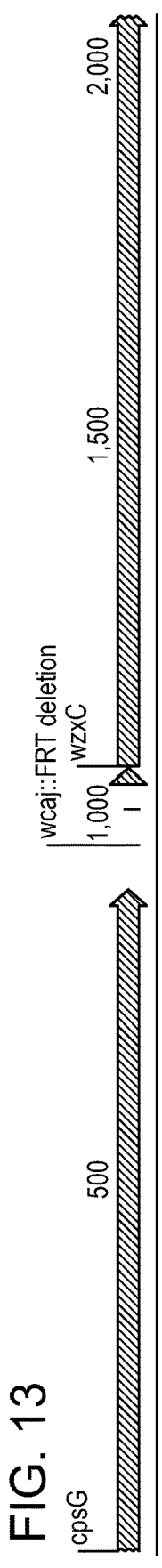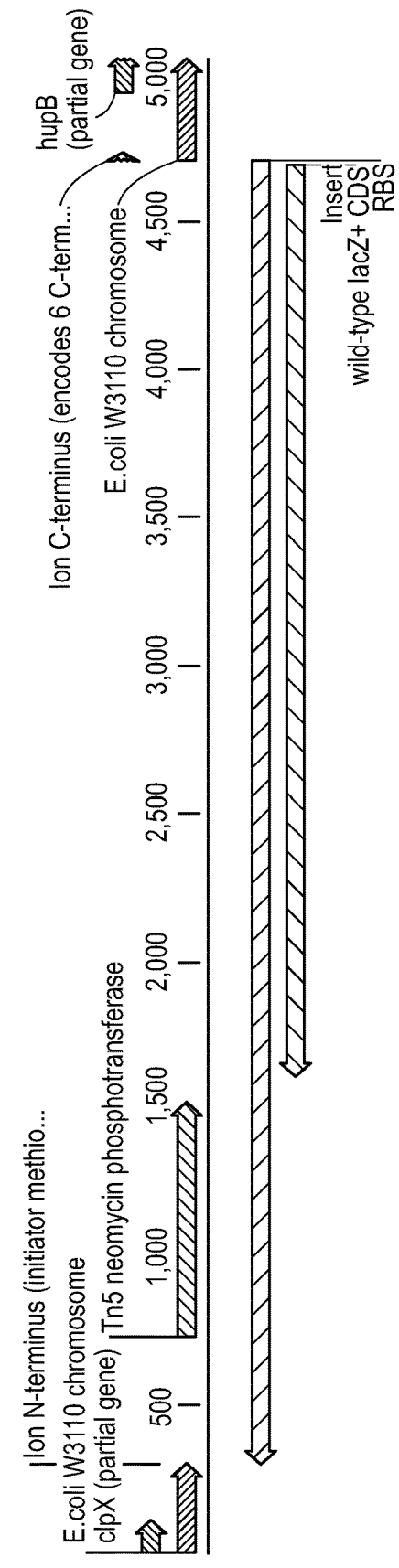
FIG. 12
FIG. 13
FIG. 14

ALPHA (1,2) FUCOSYLTRANSFERASE SYNGENES FOR USE IN THE PRODUCTION OF FUCOSYLATED OLIGOSACCHARIDES

RELATED APPLICATIONS

This application is a national stage application, filed under 35 U.S.C. § 371, of PCT International Patent Application No. PCT/US2015/030823, filed on May 14, 2015, and claims benefit of priority to U.S. Provisional Patent Application No. 61/993,742, filed on May 15, 2014, both of which, including their contents, are incorporated herein by reference in their entireties.

SEQUENCE LISTING

The instant application contains a Sequence Listing which has been submitted via EFS-Web. The content of the text file named "37847-517001US_ST25.txt", which was created on Oct. 31, 2016 and is 786 KB in size, is hereby incorporated by reference in its entirety.

FIELD OF THE INVENTION

The invention provides compositions and methods for producing purified oligosaccharides, in particular certain fucosylated oligosaccharides that are typically found in human milk.

BACKGROUND OF THE INVENTION

Human milk contains a diverse and abundant set of neutral and acidic oligosaccharides. More than 130 different complex oligosaccharides have been identified in human milk, and their structural diversity and abundance is unique to humans. Although these molecules may not be utilized directly by infants for nutrition, they nevertheless serve critical roles in the establishment of a healthy gut microbiome, in the prevention of disease, and in immune function. Prior to the invention described herein, the ability to produce human milk oligosaccharides (HMOS) inexpensively was problematic. For example, their production through chemical synthesis was limited by stereo-specificity issues, precursor availability, product impurities, and high overall cost. As such, there is a pressing need for new strategies to inexpensively manufacture large quantities of HMOS.

SUMMARY OF THE INVENTION

The invention features an efficient and economical method for producing fucosylated oligosaccharides. Such production of a fucosylated oligosaccharide is accomplished using an isolated nucleic acid comprising a sequence encoding a lactose-utilizing α (1,2) fucosyltransferase gene product (e.g., polypeptide or protein), which is operably linked to one or more heterologous control sequences that direct the production of the recombinant fucosyltransferase gene product in a host production bacterium such as *Escherichia coli* (*E. coli*).

The present disclosure provides novel α (1,2) fucosyltransferases (also referred to herein as α(1,2) FTs) that utilize lactose and catalyzes the transfer of an L-fucose sugar from a GDP-fucose donor substrate to an acceptor substrate in an alpha-1,2-linkage. In a preferred embodiment, the acceptor substrate is an oligosaccharide. The α(1,2) fucosyltransferases identified and described herein are useful for expressing in host bacterium for the production of human milk oligosaccharides (HMOS), such as fucosylated oligosaccharides. Exemplary fucosylated oligosaccharides produced by the methods described herein include 2'-fucosyllactose (2'FL), lactodifucotetraose (LDFT), lacto-N-fucopentaose I (LNF I), or lacto-N-difucohexaose I (LDFH I). The "α(1,2) fucosyltransferases" disclosed herein encompasses the amino acid sequences of the α(1,2) fucosyltransferases and the nucleic acid sequences that encode the α(1,2) fucosyltransferases, as well as variants and fragments thereof that exhibit α(1,2) fucosyltransferase activity. Also within the invention is a nucleic acid construct comprising an isolated nucleic acid encoding a lactose-accepting α (1,2) fucosyltransferase enzyme, said nucleic acid being optionally operably linked to one or more heterologous control sequences that direct the production of the enzyme in a host bacteria production strain.

The amino acid sequence of the lactose-accepting α(1,2) fucosyltransferases described herein is at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95% identity to *Helicobacter pylori* 26695 alpha-(1,2) fucosyltransferase (futC or SEQ ID NO: 1). Preferably, the lactose-accepting α(1,2) fucosyltransferases described herein is at least 22% identical to *H. pylori* FutC, or SEQ ID NO: 1.

In another aspect, the amino acid sequence of the lactose-accepting α(1,2) fucosyltransferases described herein is at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95% identity to *Bacteroides vulgatus* alpha-(1,2) fucosyltransferase (FutN or SEQ ID NO: 3). Preferably, the lactose-accepting α(1,2) fucosyltransferases described herein is at least 25% identical to *B. vlugatos* FutN, or SEQ ID NO: 3.

Alternatively, the exogenous α (1,2) fucosyltransferase preferably comprises at least at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95% identity to any one of the novel α (1,2) fucosyltransferases disclosed herein, for example, to the amino acid sequences in Table 1.

Exemplary α(1,2) fucosyltransferases include, but are not limited to, *Prevotella melaninogenica* FutO, *Clostridium bolteae* FutP, *Clostridium bolteae*+13 FutP, *Lachnospiraceae* sp. FutQ, *Methanosphaerula palustris* FutR, *Tannerella* sp. FutS, *Bacteroides caccae* FutU, *Butyrivibrio* FutV, *Prevotella* sp. FutW, *Parabacteroides johnsonii* FutX, *Akkermansia muciniphilia* FutY, *Salmonella enterica* FutZ, *Bacteroides* sp. FutZA. For example, the α(1,2) fucosyltransferases comprise the amino acid sequences comprising any one of the following: *Prevotella melaninogenica* FutO (SEQ ID NO: 10), *Clostridium bolteae* FutP (SEQ ID NO: 11), *Clostridium bolteae*+13 FutP (SEQ ID NO: 292), *Lachnospiraceae* sp. FutQ (SEQ ID NO: 12), *Methanosphaerula palustris* FutR (SEQ ID NO: 13), *Tannerella* sp. FutS (SEQ ID NO: 14), *Bacteroides caccae* FutU (SEQ ID NO: 15), *Butyrivibrio* FutV (SEQ ID NO: 16), *Prevotella* sp. FutW (SEQ ID NO: 17), *Parabacteroides johnsonii* FutX (SEQ ID NO: 18), *Akkermansia muciniphilia* FutY (SEQ ID NO: 19), *Salmonella enterica* FutZ (SEQ ID NO: 20), and *Bacteroides* sp. FutZA (SEQ ID NO: 21), or a functional variant or fragment thereof. Other exemplary α(1,2) fucosyltransferases include any of the enzymes listed in Table 1, or functional variants or fragments thereof.

The present invention features a method for producing a fucosylated oligosaccharide in a bacterium by providing bacterium that express at least one exogenous lactose-utilizing α(1,2) fucosyltransferase. The amino acid sequence of the exogenous lactose-utilizing α(1,2) fucosyltransferase is preferably at least 22% identical to *H. pylori* FutC or at least 25% identical to *B. vulgatus* FutN. In one aspect, the bacterium also expresses one or more exogenous lactose-utilizing α(1,3) fucosyltransferase enzymes and/or one or more exogenous lactose-utilizing α(1,4) fucosyltransferase enzymes. The combination of fucosyltransferases expressed in the production bacterium is dependent upon the desired fucosylated oligosaccharide product. The method disclosed herein further includes retrieving the fucosylated oligosaccharide from said bacterium or from a culture supernatant of said bacterium.

Examples of suitable α(1,3) fucosyltransferase enzymes include, but are not limited to *Helicobacter pylori* 26695 futA gene (GenBank Accession Number HV532291 (GI: 365791177), incorporated herein by reference), *H. hepaticus* Hh0072, *H. pylori* 11639 FucT, and *H. pylori* UA948 FucTa (e.g., GenBank Accession Number AF194963 (GI: 28436396), incorporated herein by reference) (Rasko, D. A., Wang, G., Palcic, M. M. & Taylor, D. E. J Biol Chem 275, 4988-4994 (2000)). Examples of suitable α(1,4) fucosyltransferase enzymes include, but are not limited to *H. pylori* UA948 FucTa (which has has relaxed acceptor specificity and is able to generate both α(1,3)- and α(1,4)-fucosyl linkages). An example of an enzyme possessing only α(1,4) fucosyltransferase activity is given by the FucT III enzyme from *Helicobacter pylori* strain DMS6709 (e.g., GenBank Accession Number AY450598.1 (GI:40646733), incorporated herein by reference) (S. Rabbani, V. Miksa, B. Wipf, B. Ernst, Glycobiology 15, 1076-83 (2005).)

The invention also features a nucleic acid construct or a vector comprising a nucleic acid enconding at least one α(1,2) fucosyltransferase or variant, or fragment thereof, as described herein. The vector can further include one or more regulatory elements, e.g., a heterologous promoter. By "heterologous" is meant that the control sequence and protein-encoding sequence originate from different bacterial strains. The regulatory elements can be operably linked to a gene encoding a protein, a gene construct encoding a fusion protein gene, or a series of genes linked in an operon in order to express the fusion protein. In yet another aspect, the invention comprises an isolated recombinant cell, e.g., a bacterial cell containing an aforementioned nucleic acid molecule or vector. The nucleic acid is optionally integrated into the genome of the host bacterium. In some embodiments, the nucleic acid construct also further comprises one or more α(1,3) fucosyltransferases and/or α(1,4) fucosyltransferases. Alternatively, the α (1,2) fucosyltransferase also exhibits α(1,3) fucosyltransferase and/or α(1,4) fucosyltransferase activity.

The bacterium utilized in the production methods described herein is genetically engineered to increase the efficiency and yield of fucosylated oligosaccharide products. For example, the host production bacterium is characterized as having a reduced level of β-galactosidase activity, a defective colanic acid synthesis pathway, an inactivated ATP-dependent intracellular protease, an inactivated lacA, or a combination thereof. In one embodiment, the bacterium is characterized as having a reduced level of β-galactosidase activity, a defective colanic acid synthesis pathway, an inactivated ATP-dependent intracellular protease, and an inactivated lacA.

As used herein, an "inactivated" or "inactivation of a" gene, encoded gene product (i.e., polypeptide), or pathway refers to reducing or eliminating the expression (i.e., transcription or translation), protein level (i.e., translation, rate of degradation), or enzymatic activity of the gene, gene product, or pathway. In the instance where a pathway is inactivated, preferably one enzyme or polypeptide in the pathway exhibits reduced or negligible activity. For example, the enzyme in the pathway is altered, deleted or mutated such that the product of the pathway is produced at low levels compared to a wild-type bacterium or an intact pathway. Alternatively, the product of the pathway is not produced. Inactivation of a gene is achieved by deletion or mutation of the gene or regulatory elements of the gene such that the gene is no longer transcribed or translated. Inactivation of a polypeptide can be achieved by deletion or mutation of the gene that encodes the gene product or mutation of the polypeptide to disrupt its activity. Inactivating mutations include additions, deletions or substitutions of one or more nucleotides or amino acids of a nucleic acid or amino acid sequence that results in the reduction or elimination of the expression or activity of the gene or polypeptide. In other embodiments, inactivation of a polypeptide is achieved through the addition of exogenous sequences (i.e., tags) to the N or C-terminus of the polypeptide such that the activity of the polypeptide is reduced or eliminated (i.e., by steric hindrance).

A host bacterium suitable for the production systems described herein exhibits an enhanced or increased cytoplasmic or intracellular pool of lactose and/or GDP-fucose. For example, the bacterium is *E. coli* and endogenous *E. coli* metabolic pathways and genes are manipulated in ways that result in the generation of increased cytoplasmic concentrations of lactose and/or GDP-fucose, as compared to levels found in wild type *E. coli*. Preferably, the bacterium accumulates an increased intracellular lactose pool and an increased intracellular GDP-fucose pool. For example, the bacteria contain at least 10%, 20%, 50%, or 2×, 5×, 10× or more of the levels of intracellular lactose and/or intracellular GDP-fucose compared to a corresponding wild type bacteria that lacks the genetic modifications described herein.

Increased intracellular concentration of lactose in the host bacterium compared to wild-type bacterium is achieved by manipulation of genes and pathways involved in lactose import, export and catabolism. In particular, described herein are methods of increasing intracellular lactose levels in *E. coli* genetically engineered to produce a human milk oligosaccharide by simultaneous deletion of the endogenous β-galactosidase gene (lacZ) and the lactose operon repressor gene (laI). During construction of this deletion, the lacIq promoter is placed immediately upstream of (contiguous with) the lactose permease gene, lacY, i.e., the sequence of the lacIq promoter is directly upstream and adjacent to the start of the sequence encoding the lacY gene, such that the lacY gene is under transcriptional regulation by the lacIq promoter. The modified strain maintains its ability to transport lactose from the culture medium (via LacY), but is deleted for the wild-type chromosomal copy of the lacZ (encoding β-galactosidase) gene responsible for lactose catabolism. Thus, an intracellular lactose pool is created when the modified strain is cultured in the presence of exogenous lactose.

Another method for increasing the intracellular concentration of lactose in *E. coli* involves inactivation of the lacA gene. A inactivating mutation, null mutation, or deletion of lacA prevents the formation of intracellular acetyl-lactose, which not only removes this molecule as a contaminant from subsequent purifications, but also eliminates *E. coli*'s ability to export excess lactose from its cytoplasm (Danchin A. Cells need safety valves. Bioessays 2009, July; 31(7):769-73.), thus greatly facilitating purposeful manipulations of the *E. coli* intracellular lactose pool.

The invention also provides methods for increasing intracellular levels of GDP-fucose in a bacterium by manipulating the organism's endogenous colanic acid biosynthesis pathway. This increase is achieved through a number of genetic modifications of endogenous *E. coli* genes involved either directly in colanic acid precursor biosynthesis, or in overall control of the colanic acid synthetic regulon. Particularly preferred is inactivation of the genes or encoded polypeptides that act in the colanic acid synthesis pathway after the production of GDP-fucose (the donor substrate) and before the generation of colanic acid. Exemplary colanic acid synthesis genes include, but are not limited to: a wcaJ gene, (e.g., GenBank Accession Number (amino acid) BAA15900 (GI:1736749), incorporated herein by reference), a wcaA gene (e.g., GenBank Accession Number (amino acid) BAA15912.1 (GI:1736762), incorporated herein by reference), a wcaC gene (e.g., GenBank Accession Number (amino acid) BAE76574.1 (GI:85675203), incorporated herein by reference), a wcaE gene (e.g., GenBank Accession Number (amino acid) BAE76572.1 (GI: 85675201), incorporated herein by reference), a wcaI gene (e.g., GenBank Accession Number (amino acid) BAA15906.1 (GI:1736756), incorporated herein by reference), a wcaL gene (e.g., GenBank Accession Number (amino acid) BAA15898.1 (GI:1736747), incorporated herein by reference), a wcaB gene (e.g., GenBank Accession Number (amino acid) BAA15911.1 (GI:1736761), incorporated herein by reference), a wcaF gene (e.g., GenBank Accession Number (amino acid) BAA15910.1 (GI: 1736760), incorporated herein by reference), a wzxE gene (e.g., GenBank Accession Number (amino acid) BAE77506.1 (GI:85676256), incorporated herein by reference), a wzxC gene, (e.g., GenBank Accession Number (amino acid) BAA15899 (GI:1736748), incorporated herein by reference), a wcaD gene, (e.g., GenBank Accession Number (amino acid) BAE76573 (GI:85675202), incorporated herein by reference), a wza gene (e.g., GenBank Accession Number (amino acid) BAE76576 (GI:85675205), incorporated herein by reference), a wzb gene (e.g., GenBank Accession Number (amino acid) BAE76575 (GI: 85675204), incorporated herein by reference), and a wzc gene (e.g., GenBank Accession Number (amino acid) BAA15913 (GI:1736763), incorporated herein by reference).

Preferably, a host bacterium, such as *E. coli*, is genetically engineered to produce a human milk oligosaccharide by the inactivation of the wcaJ gene, which encoding the UDP-glucose lipid carrier transferase. The inactivation of the wcaJ gene can be by deletion of the gene, a null mutation, or inactivating mutation of the wad gene, such that the activity of the encoded wcaJ is reduced or eliminated compared to wild-type *E. coli*. In a wcaJ null background, GDP-fucose accumulates in the *E. coli* cytoplasm.

Over-expression of a positive regulator protein, RcsA (e.g., GenBank Accession Number M58003 (GI:1103316), incorporated herein by reference), in the colanic acid synthesis pathway results in an increase in intracellular GDP-fucose levels. Over-expression of an additional positive regulator of colanic acid biosynthesis, namely RcsB (e.g., GenBank Accession Number E04821 (GI:2173017), incorporated herein by reference), is also utilized, either instead of or in addition to over-expression of RcsA, to increase intracellular GDP-fucose levels.

Alternatively, colanic acid biosynthesis is increased following the introduction of a mutation into the *E. coli* lon gene (e.g., GenBank Accession Number L20572 (GI: 304907), incorporated herein by reference). Lon is an adenosine-5'-triphosphate (ATP)-dependant intracellular protease that is responsible for degrading RcsA, mentioned above as a positive transcriptional regulator of colanic acid biosynthesis in *E. coli*. In a lon null background, RcsA is stabilized, RcsA levels increase, the genes responsible for GDP-fucose synthesis in *E. coli* are up-regulated, and intracellular GDP-fucose concentrations are enhanced. Mutations in lon suitable for use with the methods presented herein include null mutations or insertions that disrupt the expression or function of lon.

A functional lactose permease gene is also present in the bacterium. The lactose permease gene is an endogenous lactose permease gene or an exogenous lactose permease gene. For example, the lactose permease gene comprises an *E. coli* lacY gene (e.g., GenBank Accession Number V00295 (GI:41897), incorporated herein by reference). Many bacteria possess the inherent ability to transport lactose from the growth medium into the cell, by utilizing a transport protein that is either a homolog of the *E. coli* lactose permease (e.g., as found in *Bacillus licheniformis*), or a transporter that is a member of the ubiquitous PTS sugar transport family (e.g., as found in *Lactobacillus casei* and *Lactobacillus rhamnosus*). For bacteria lacking an inherent ability to transport extracellular lactose into the cell cytoplasm, this ability is conferred by an exogenous lactose transporter gene (e.g., *E. coli* lacY) provided on recombinant DNA constructs, and supplied either on a plasmid expression vector or as exogenous genes integrated into the host chromosome.

As described herein, in some embodiments, the host bacterium preferably has a reduced level of β-galactosidase activity. In the embodiment in which the bacterium is characterized by the deletion of the endogenous β-galactosidase gene, an exogenous β-galactosidase gene is introduced to the bacterium. For example, a plasmid expressing an exogenous β-galactosidase gene is introduced to the bacterium, or recombined or integrated into the host genome. For example, the exogenous β-galactosidase gene is inserted into a gene that is inactivated in the host bacterium, such as the lon gene.

The exogenous b-galactosidase gene is a functional b-galactosidase gene characterized by a reduced or low level of b-galactosidase activity compared to β-galactosidase activity in wild-type bacteria lacking any genetic manipulation. Exemplary β-galactosidase genes include *E. coli* lacZ and β-galactosidase genes from any of a number of other organisms (e.g., the lac4 gene of *Kluyveromyces lactis* (e.g., GenBank Accession Number M84410 (GI:173304), incorporated herein by reference) that catalyzes the hydrolysis of b-galactosides into monosaccharides. The level of β-galactosidase activity in wild-type *E. coli* bacteria is, for example, 6,000 units. Thus, the reduced β-galactosidase activity level encompassed by engineered host bacterium of the present invention includes less than 6,000 units, less than 5,000 units, less than 4,000 units, less than 3,000 units, less than 2,000 units, less than 1,000 units, less than 900 units, less than 800 units, less than 700 units, less than 600 units, less than 500 units, less than 400 units, less than 300 units, less than 200 units, less than 100 units, or less than 50 units. Low, functional levels of β-galactosidase include β-galactosidase activity levels of between 0.05 and 1,000 units, e.g., between 0.05 and 750 units, between 0.05 and 500 units, between 0.05 and 400 units, between 0.05 and 300 units, between 0.05 and 200 units, between 0.05 and 100 units, between 0.05 and 50 units, between 0.05 and 10 units, between 0.05 and 5 units, between 0.05 and 4 units, between 0.05 and 3 units, or between 0.05 and 2 units of β-galactosidase activity. For unit definition and assays for determining β-galactosidase activity, see Miller J H, Laboratory CSH. Experiments in molecular genetics. Cold Spring Harbor Laboratory Cold Spring Harbor, N.Y.; 1972; (incorporated herein by reference). This low level of cytoplasmic β-galactosidase activity is not high enough to significantly diminish the intracellular lactose pool. The low level of β-galactosidase activity is very useful for the facile removal of undesired residual lactose at the end of fermentations.

Optionally, the bacterium has an inactivated thyA gene. Preferably, a mutation in a thyA gene in the host bacterium allows for the maintenance of plasmids that carry thyA as a selectable marker gene. Exemplary alternative selectable markers include antibiotic resistance genes such as BLA (beta-lactamase), or proBA genes (to complement a proAB host strain proline auxotropy) or purA (to complement a purA host strain adenine auxotrophy).

In one aspect, the *E. coli* bacterium comprises the genotype ΔampC::$P_{trp}^{B}$cI, Δ(lacI-lacZ)::FRT, $P_{lacIq}$lacY⁺, ΔwcaJ::FRT, thyA::Tn10, Δlon:(npt3, lacZ⁺), ΔlacA, and also comprises any one of the exogenous α(1,2) fucosyltransferases described herein.

The bacterium comprising these characteristics is cultured in the presence of lactose. In some cases, the method further comprises culturing the bacterium in the presence of tryptophan and in the absence of thymidine. The fucosylated oligosaccharide is retrieved from the bacterium (i.e., a cell lysate) or from a culture supernatant of the bacterium.

The invention provides a purified fucosylated oligosaccharide produced by the methods described herein. The fucosylated oligosaccharide is purified for use in therapeutic or nutritional products, or the bacterium is used directly in such products. The fucosylated oligosaccharide produced by the engineered bacterium is 2'-fucosyllactose (2'-FL) or lactodifucotetraose (LDFT). The new alpha 1,2-fucosyltransferases are also useful to synthesize HMOS of larger molecular weight bearing alpha 1,2 fucose moieties, e.g., lacto-N-fucopentaose (LNF I) and lacto-N-difucohexaose (LDFH I). For example, to produce LDFT, the host bacterium is engineered to express an exogenous α (1,2) fucosyltransferase that also possesses α (1,3) fucosyltransferase activity, or an exogenous α (1,2) fucosyltransferase and an exogenous α (1,3) fucosyltransferase. For the production of LNF I and LDFH I, the host bacterium is engineered to express an exogenous α (1,2) fucosyltransferase that also possesses α (1,3) fucosyltransferase activity and/or α (1,4) fucosyltransferase activity, or an exogenous α (1,2) fucosyltransferase, an exogenous α (1,3) fucosyltransferas, and an exogenous α (1,4) fucosyltransferase.

A purified fucosylated oligosaccharide produced by the methods described above is also within the invention. The purified oligosaccharide (2'-FL) obtained at the end of the process is a white/slightly off-white, crystalline, sweet powder. For example, an engineered bacterium, bacterial culture supernatant, or bacterial cell lysate according to the invention comprises 2'-FL, LDFT, LNF I or LDFH I produced by the methods described herein, and does not substantially comprise a other fucosylated oligosaccharides prior to purification of the fucosylated oligosaccharide products from the cell, culture supernatant, or lysate. As a general matter, the fucosylated oligosaccharide produced by the methods contains a negligible amount of 3-FL in a 2'-FL-containing cell, cell lysate or culture, or supernatant, e.g., less than 1% of the level of 2'-FL or 0.5% of the level of 2'-FL. Moreover, the fucosylated oligosaccharide produced by the methods described herein also have a minimal amount of contaminating lactose, which can often be co-purified with the fucosylated oligosaccharide product, such as 2'FL. This reduction in contaminating lactose results from the reduced level of β-galactosidase activity present in the engineered host bacterium.

A purified oligosaccharide, e.g., 2'-FL, LDFT, LNF I, or LDFH I, is one that is at least 90%, 95%, 98%, 99%, or 100% (w/w) of the desired oligosaccharide by weight. Purity is assessed by any known method, e.g., thin layer chromatography or other chromatographic techniques known in the art. The invention includes a method of purifying a fucosylated oligosaccharide produced by the genetically engineered bacterium described above, which method comprises separating the desired fucosylated oligosaccharide (e.g., 2'-FL) from contaminants in a bacterial cell lysate or bacterial cell culture supernatant of the bacterium.

The oligosaccharides are purified and used in a number of products for consumption by humans as well as animals, such as companion animals (dogs, cats) as well as livestock (bovine, equine, ovine, caprine, or porcine animals, as well as poultry). For example, a pharmaceutical composition comprises purified 2'-FL and a pharmaceutically-acceptable excipient that is suitable for oral administration. Large quantities of 2'-FL are produced in bacterial hosts, e.g., an *E. coli* bacterium comprising an exogenous α (1,2) fucosyltransferase gene.

A method of producing a pharmaceutical composition comprising a purified human milk oligosaccharide (HMOS) is carried out by culturing the bacterium described above, purifying the HMOS produced by the bacterium, and combining the HMOS with an excipient or carrier to yield a dietary supplement for oral administration. These compositions are useful in methods of preventing or treating enteric and/or respiratory diseases in infants and adults. Accordingly, the compositions are administered to a subject suffering from or at risk of developing such a disease.

The invention also provides methods of identifying an α (1,2) fucosyltransferase gene capable of synthesizing fucosylated oligosaccharides in a host bacterium, i.e., 2'-fucosyllactose (2'-FL) in *E. coli*. The method of identifying novel lactose-utilizing, α(1,2)fucosyltransferase enzyme comprises the following steps:

1) performing a computational search of sequence databases to define a broad group of simple sequence homologs of any known, lactose-utilizing α(1,2)fucosyltransferase;

2) using the list from step (1), deriving a search profile containing common sequence and/or structural motifs shared by the members of the list;

3) searching sequence databases, using a derived search profile based on the common sequence or structural motif from step (2) as query, and identifying a candidate sequences, wherein a sequence homology to a reference lactose-utilizing α(1,2)fucosyltransferase is a predetermined percentage threshold;

4) compiling a list of candidate organisms, said organisms being characterized as expressing α(1,2)fucosyl-glycans in a naturally-occurring state;

5) selecting candidate sequences that are derived from candidate organisms to generate a list of candidate lactose-utilizing enzymes;

6) expressing the candidate lactose-utilizing enzyme in a host organism; and 7) testing for lactose-utilizing α(1,2)fucosyltransferase activity, wherein detection of the desired fucosylated oligosaccharide product in said organism indicates that the candidate sequence comprises a novel lactose-utilizing α(1,2) fucosyltransferase. In another embodiment, the search profile is generated from a multiple sequence alignment of the amino acid sequences of more than one enzyme with known α(1,2)fucosyltransferase activity. The database search can then be designed to refine and iteratively search for novel α(1,2)fucosyltransferases with significant sequence similarity to the multiple sequence alignment query.

The invention provides a method of treating, preventing, or reducing the risk of infection in a subject comprising administering to said subject a composition comprising a purified recombinant human milk oligosaccharide, wherein the HMOS binds to a pathogen and wherein the subject is infected with or at risk of infection with the pathogen. In one aspect, the infection is caused by a Norwalk-like virus or *Campylobacter jejuni*. The subject is preferably a mammal in need of such treatment. The mammal is, e.g., any mammal, e.g., a human, a primate, a mouse, a rat, a dog, a cat, a cow, a horse, or a pig. In a preferred embodiment, the mammal is a human. For example, the compositions are formulated into animal feed (e.g., pellets, kibble, mash) or animal food supplements for companion animals, e.g., dogs or cats, as well as livestock or animals grown for food consumption, e.g., cattle, sheep, pigs, chickens, and goats. Preferably, the purified HMOS is formulated into a powder (e.g., infant formula powder or adult nutritional supplement powder, each of which is mixed with a liquid such as water or juice prior to consumption) or in the form of tablets, capsules or pastes or is incorporated as a component in dairy products such as milk, cream, cheese, yogurt or kefir, or as a component in any beverage, or combined in a preparation containing live microbial cultures intended to serve as probiotics, or in prebiotic preparations to enhance the growth of beneficial microorganisms either in vitro or in vivo.

Polynucleotides, polypeptides, and oligosaccharides of the invention are purified and/or isolated. Purified defines a degree of sterility that is safe for administration to a human subject, e.g., lacking infectious or toxic agents. Specifically, as used herein, an "isolated" or "purified" nucleic acid molecule, polynucleotide, polypeptide, protein or oligosaccharide, is substantially free of other cellular material, or culture medium when produced by recombinant techniques, or chemical precursors or other chemicals when chemically synthesized. For example, purified HMOS compositions are at least 60% by weight (dry weight) the compound of interest. Preferably, the preparation is at least 75%, more preferably at least 90%, and most preferably at least 99%, by weight the compound of interest. Purity is measured by any appropriate standard method, for example, by column chromatography, thin layer chromatography, or high-performance liquid chromatography (HPLC) analysis. For example, a "purified protein" refers to a protein that has been separated from other proteins, lipids, and nucleic acids with which it is naturally associated. Preferably, the protein constitutes at least 10, 20, 50, 70, 80, 90, 95, 99-100% by dry weight of the purified preparation.

Similarly, by "substantially pure" is meant an oligosaccharide that has been separated from the components that naturally accompany it. Typically, the oligosaccharide is substantially pure when it is at least 60%, 70%, 80%, 90%, 95%, or even 99%, by weight, free from the proteins and naturally-occurring organic molecules with which it is naturally associated.

By "isolated nucleic acid" is meant a nucleic acid that is free of the genes which, in the naturally-occurring genome of the organism from which the DNA of the invention is derived, flank the gene. The term covers, for example: (a) a DNA which is part of a naturally occurring genomic DNA molecule, but is not flanked by both of the nucleic acid sequences that flank that part of the molecule in the genome of the organism in which it naturally occurs; (b) a nucleic acid incorporated into a vector or into the genomic DNA of a prokaryote or eukaryote in a manner, such that the resulting molecule is not identical to any naturally occurring vector or genomic DNA; (c) a separate molecule such as a cDNA, a genomic fragment, a fragment produced by polymerase chain reaction (PCR), or a restriction fragment; and (d) a recombinant nucleotide sequence that is part of a hybrid gene, i.e., a gene encoding a fusion protein. Isolated nucleic acid molecules according to the present invention further include molecules produced synthetically, as well as any nucleic acids that have been altered chemically and/or that have modified backbones.

A "heterologous promoter" is a promoter which is different from the promoter to which a gene or nucleic acid sequence is operably linked in nature.

The term "overexpress" or "overexpression" refers to a situation in which more factor is expressed by a genetically-altered cell than would be, under the same conditions, by a wild type cell. Similarly, if an unaltered cell does not express a factor that it is genetically altered to produce, the term "express" (as distinguished from "overexpress") is used indicating the wild type cell did not express the factor at all prior to genetic manipulation.

The terms "treating" and "treatment" as used herein refer to the administration of an agent or formulation to a clinically symptomatic individual afflicted with an adverse condition, disorder, or disease, so as to effect a reduction in severity and/or frequency of symptoms, eliminate the symptoms and/or their underlying cause, and/or facilitate improvement or remediation of damage. The terms "preventing" and "prevention" refer to the administration of an agent or composition to a clinically asymptomatic individual who is susceptible to a particular adverse condition, disorder, or disease, and thus relates to the prevention of the occurrence of symptoms and/or their underlying cause.

By the terms "effective amount" and "therapeutically effective amount" of a formulation or formulation component is meant a nontoxic but sufficient amount of the formulation or component to provide the desired effect.

The transitional term "comprising," which is synonymous with "including," "containing," or "characterized by," is inclusive or open-ended and does not exclude additional, unrecited elements or method steps. By contrast, the transitional phrase "consisting of" excludes any element, step, or ingredient not specified in the claim. The transitional phrase "consisting essentially of" limits the scope of a claim to the specified materials or steps "and those that do not materially affect the basic and novel characteristic(s)" of the claimed invention.

The host organism used to express the lactose-accepting fucosyltransferase gene is typically the enterobacterium *Escherichia coli* K12 (*E. coli*). *E. coli* K-12 is not considered a human or animal pathogen nor is it toxicogenic. *E. coli* K-12 is a standard production strain of bacteria and is noted for its safety due to its poor ability to colonize the colon and establish infections (see, e.g., epa.gov/oppt/biotech/pubs/ fra/fra004.htm). However, a variety of bacterial species may be used in the oligosaccharide biosynthesis methods, e.g., *Erwinia herbicola* (*Pantoea agglomerans*), *Citrobacter freundii*, *Pantoea citrea*, *Pectobacterium carotovorum*, or *Xanthomonas campestris*. Bacteria of the genus *Bacillus* may also be used, including *Bacillus subtilis, Bacillus licheniformis, Bacillus coagulans, Bacillus thermophilus, Bacillus laterosporus, Bacillus megaterium, Bacillus mycoides, Bacillus pumilus, Bacillus lentos, Bacillus cereus,* and *Bacillus circulans*. Similarly, bacteria of the genera *Lactobacillus* and *Lactococcus* may be modified using the methods of this invention, including but not limited to *Lactobacillus acidophilus, Lactobacillus salivarius, Lactobacillus plantarum, Lactobacillus helveticus, Lactobacillus delbrueckii, Lactobacillus rhamnosus, Lactobacillus bulgaricus, Lactobacillus crispatus, Lactobacillus gasseri, Lactobacillus casei, Lactobacillus reuteri, Lactobacillus jensenii,* and *Lactococcus lactis. Streptococcus thermophiles* and *Proprionibacterium freudenreichii* are also suitable bacterial species for the invention described herein. Also included as part of this invention are strains, modified as described here, from the genera *Enterococcus* (e.g., *Enterococcus faecium* and *Enterococcus thermophiles*), *Bifidobacterium* (e.g., *Bifidobacterium longum, Bifidobacterium infantis,* and *Bifidobacterium bifidum*), *Sporolactobacillus* spp., *Micromomospora* spp., *Micrococcus* spp., *Rhodococcus* spp., and *Pseudomonas* (e.g., *Pseudomonas fluorescens* and *Pseudomonas aeruginosa*). Bacteria comprising the characteristics described herein are cultured in the presence of lactose, and a fucosylated oligosaccharide is retrieved, either from the bacterium itself or from a culture supernatant of the bacterium. The fucosylated oligosaccharide is purified for use in therapeutic or nutritional products, or the bacteria are used directly in such products. A suitable production host bacterial strain is one that is not the same bacterial strain as the source bacterial strain from which the fucosyltransferase-encoding nucleic acid sequence was identified.

Other features and advantages of the invention will be apparent from the following description of the preferred embodiments thereof, and from the claims. Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All published foreign patents and patent applications cited herein are incorporated herein by reference. Genbank and NCBI submissions indicated by accession number cited herein are incorporated herein by reference. All other published references, documents, manuscripts and scientific literature cited herein are incorporated herein by reference. In the case of conflict, the present specification, including definitions, will control. In addition, the materials, methods, and examples are illustrative only and not intended to be limiting.

BRIEF DESCRIPTION OF THE DRAWINGS

FIG. 3A and FIG. 3B show the sequence identity and a multiple sequence alignment of 4 previously known lactose-utilizing α(1,2)-fucosyltransferase protein sequences. FIG. 3A is a table showing the sequence identity between the 4 known lactose-utilizing α(1,2)-fucosyltransferases: *H. pylori* futC (SEQ ID NO: 1), *H. mustelae* FutL (SEQ ID NO: 2), *Bacteroides vulgatus* futN (SEQ ID NO: 3), and *E. coli* 0126 wbgL (SEQ ID NO: 4). FIG. 3B shows multiple sequence alignment of the 4 known α(1,2)-fucosyltransferases. The ovals highlight regions of particularly high sequence conservation between the four enzymes in the alignment.

FIG. 4 shows the sequence alignment of the 12 identified α(1,2)-fucosyltransferase syngenes identified, along with the 4 previously known lactose-utilizing α(1,2)-fucosyltransferase protein sequences. The 4 known lactose-utilizing α(1,2)-fucosyltransferases are boxed and include *H. pylori* futC (SEQ ID NO: 1), *H. mustelae* FutL (SEQ ID NO: 2), *Bacteroides vulgatus* futN (SEQ ID NO: 3), and *E. coli* 0126 wbgL (SEQ ID NO: 4). The 12 identified α(1,2)-fucosyltransferase are as follows: *Prevotella melaninogenica* FutO (SEQ ID NO: 10), *Clostridium bolteae*+13 FutP (SEQ ID NO: 292), *Lachnospiraceae* sp. FutQ (SEQ ID NO: 12), *Methanosphaerula palustris* FutR (SEQ ID NO: 13), *Tannerella* sp. FutS (SEQ ID NO: 14), *Bacteroides caccae* FutU (SEQ ID NO: 15), *Butyrivibrio* FutV (SEQ ID NO: 16), *Prevotella* sp. FutW (SEQ ID NO: 17), *Parabacteroides johnsonii* FutX (SEQ ID NO: 18), *Akkermansia muciniphilia* FutY (SEQ ID NO: 19), *Salmonella enterica* FutZ (SEQ ID NO: 20), *Bacteroides* sp. FutZA (SEQ ID NO: 21). The sequence for *Clostridium bolteae* FutP (without the 13 additional amino acids in the N-terminus) (SEQ ID NO: 11) is also shown in the alignment.

FIG. 5A shows post-Gibson assembly PCR. FIG. 5B shows gel-purified RI/Xho 1 syngene fragments.

FIG. 6A and FIG. 6B are two photographs showing thin layer chromatograms of fucosylated oligosaccharide products produced in *E. coli* cultures using the 12 novel α(1,2)-fucosyltransferase syngenes. FIG. 6A shows fucosylated oligosaccharide products from 2 μl of culture supernatant. FIG. 6B shows fucosylated oligosaccharide products from 0.2 OD$_{600}$ cell equivalents of whole cell heat extracts.

FIG. 9A shows fucosylated oligosaccharide products from 2

µl of culture supernatant. FIG. 9B shows fucosylated oligosaccharide products from 0.2 $OD_{600}$ cell equivalents of whole cell heat extracts.

FIG. 10A) 36B and FIG. 10B) 37A. The culture yield for run 36B was 33 g/L while the yield for run 37A was 36.3 g/L.

FIG. 12 is a schematic diagram showing the insertion of the LacIq promoter, the functional lacY gene, and the deletion of lacA.

FIG. 13 is a schematic diagram showing the deletion of the endogenous wcaJ gene using FRT recombination.

FIG. 14 is a schematic diagram of the *E. coli* W3110 chromosome, showing the insertion of a DNA fragment carrying kanamycin resistance gene (derived from transposon Tn5) and wild-type lacZ into the lon gene.

DETAILED DESCRIPTION OF THE INVENTION

Figure 1:
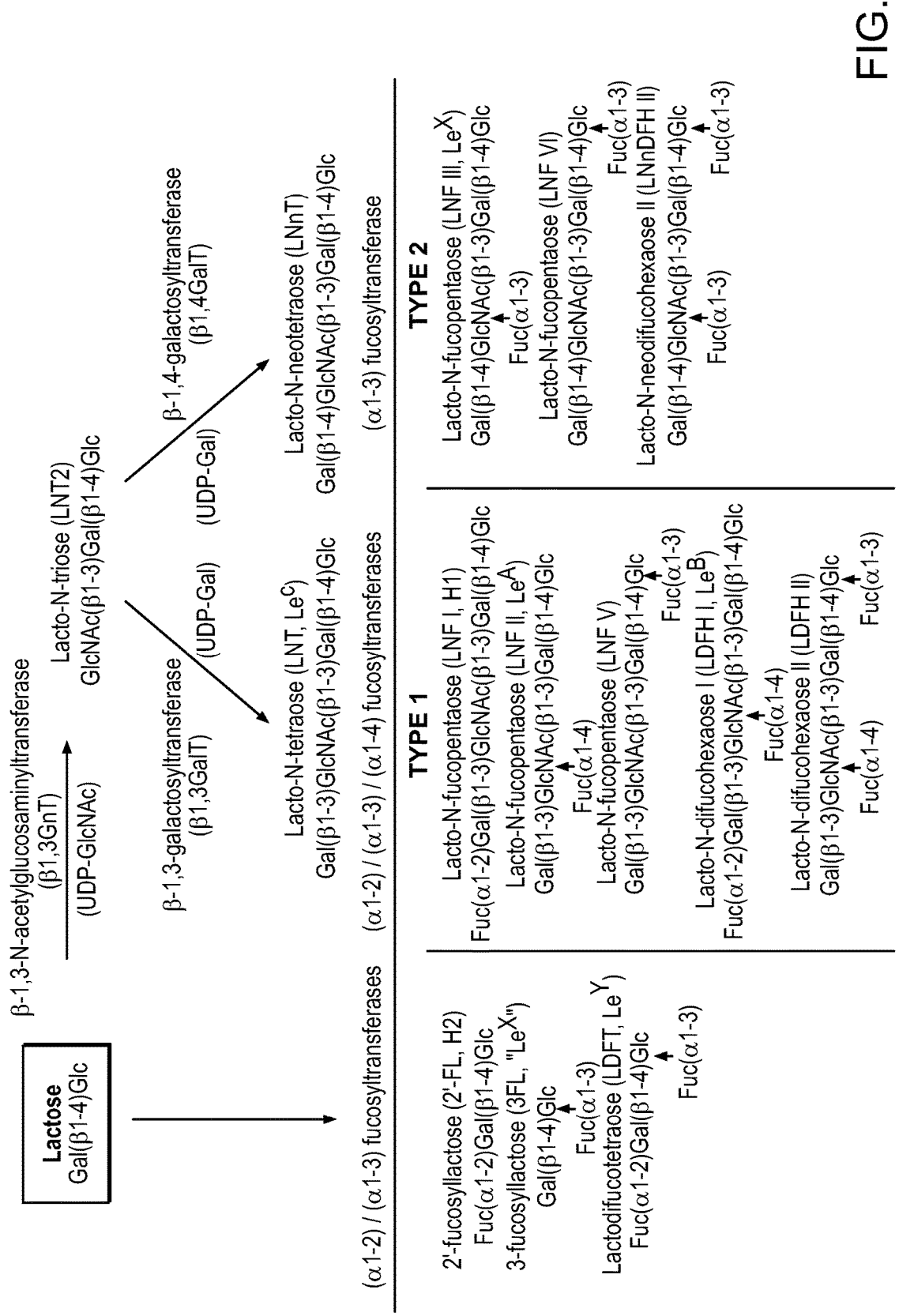
FIG. 1 is a schematic illustration showing the synthetic pathway of the major neutral fucosyl-oligosaccharides found in human milk.

While some studies suggest that human milk glycans could be used as antimicrobial anti-adhesion agents, the difficulty and expense of producing adequate quantities of these agents of a quality suitable for human consumption has limited their full-scale testing and perceived utility. What has been needed is a suitable method for producing the appropriate glycans in sufficient quantities at reasonable cost. Prior to the invention described herein, there were attempts to use several distinct synthetic approaches for glycan synthesis. Some chemical approaches can synthesize oligosaccharides (Flowers, H. M. Methods Enzymol 50, 93-121 (1978); Seeberger, P. H. Chem Commun (Camb) 1115-1121 (2003)), but reactants for these methods are expensive and potentially toxic (Koeller, K. M. & Wong, C. H. Chem Rev 100, 4465-4494 (2000)). Enzymes expressed from engineered organisms (Albermann, C., Piepersberg, W. & Wehmeier, U. F. Carbohydr Res 334, 97-103 (2001); Bettler, E., Samain, E., Chazalet, V., Bosso, C., et al. Glycoconj J 16, 205-212 (1999); Johnson, K. F. Glycoconj J 16, 141-146 (1999); Palcic, M. M. Curr Opin Biotechnol 10, 616-624 (1999); Wymer, N. & Toone, E. J. Curr Opin Chem Biol 4, 110-119 (2000)) provide a precise and efficient synthesis (Palcic, M. M. Curr Opin Biotechnol 10, 616-624 (1999)); Crout, D. H. & Vic, G. Curr Opin Chem Biol 2, 98-111 (1998)), but the high cost of the reactants, especially the sugar nucleotides, limits their utility for low-cost, large-scale production. Microbes have been genetically engineered to express the glycosyltransferases needed to synthesize oligosaccharides from the bacteria's innate pool of nucleotide sugars (Endo, T., Koizumi, S., Tabata, K., Kakita, S. & Ozaki, A. Carbohydr Res 330, 439-443 (2001); Endo, T., Koizumi, S., Tabata, K. & Ozaki, A. Appl Microbiol Biotechnol 53, 257-261 (2000); Endo, T. & Koizumi, S. Curr Opin Struct Biol 10, 536-541 (2000); Endo, T., Koizumi, S., Tabata, K., Kakita, S. & Ozaki, A. Carbohydr Res 316, 179-183 (1999); Koizumi, S., Endo, T., Tabata, K. & Ozaki, A. Nat Biotechnol 16, 847-850 (1998)). However, prior to the invention described herein, there was a growing need to identify and characterize additional glycosyltransferases that are useful for the synthesis of HMOS in metabolically engineered bacterial hosts.

Human Milk Glycans

Human milk contains a diverse and abundant set of neutral and acidic oligosaccharides (Kunz, C., Rudloff, S., Baier, W., Klein, N., and Strobel, S. (2000). Annu Rev Nutr 20, 699-722; Bode, L. (2006). J Nutr 136, 2127-130). More than 130 different complex oligosaccharides have been identified in human milk, and their structural diversity and abundance is unique to humans. Although these molecules may not be utilized directly by infants for nutrition, they nevertheless serve critical roles in the establishment of a healthy gut microbiome (Marcobal, A., Barboza, M., Froehlich, J. W., Block, D. E., et al. J Agric Food Chem 58, 5334-5340 (2010)), in the prevention of disease (Newburg, D. S., Ruiz-Palacios, G. M. & Morrow, A. L. Annu Rev Nutr 25, 37-58 (2005)), and in immune function (Newburg, D. S. & Walker, W. A. Pediatr Res 61, 2-8 (2007)). Despite millions of years of exposure to human milk oligosaccharides (HMOS), pathogens have yet to develop ways to circumvent the ability of HMOS to prevent adhesion to target cells and to inhibit infection. The ability to utilize HMOS as pathogen adherence inhibitors promises to address the current crisis of burgeoning antibiotic resistance. Human milk oligosaccharides produced by biosynthesis represent the lead compounds of a novel class of therapeutics against some of the most intractable scourges of society.

One alternative strategy for efficient, industrial-scale synthesis of HMOS is the metabolic engineering of bacteria. This approach involves the construction of microbial strains overexpressing heterologous glycosyltransferases, membrane transporters for the import of precursor sugars into the bacterial cytosol, and possessing enhanced pools of regenerating nucleotide sugars for use as biosynthetic precursors (Dumon, C., Samain, E., and Priem, B. (2004). Biotechnol Prog 20, 412-19; Ruffing, A., and Chen, R. R. (2006). Microb Cell Fact 5, 25). A key aspect of this approach is the heterologous glycosyltransferase selected for overexpression in the microbial host. The choice of glycosyltransferase can significantly affect the final yield of the desired synthesized oligosaccharide, given that enzymes can vary greatly in terms of kinetics, substrate specificity, affinity for donor and acceptor molecules, stability and solubility. A few glycosyltransferases derived from different bacterial species have been identified and characterized in terms of their ability to catalyze the biosynthesis of HMOS in *E. coli* host strains (Dumon, C., Bosso, C., Utille, J. P., Heyraud, A., and Samain, E. (2006). Chembiochem 7, 359-365; Dumon, C., Samain, E., and Priem, B. (2004). Biotechnol Prog 20, 412-19; Li, M., Liu, X. W., Shao, J., Shen, J., Jia, Q., Yi, W., Song, J. K., Woodward, R., Chow, C. S., and Wang, P. G. (2008). Biochemistry 47, 378-387). The identification of additional glycosyltransferases with faster kinetics, greater affinity for nucleotide sugar donors and/or acceptor molecules, or greater stability within the bacterial host significantly improves the yields of therapeutically useful HMOS. Prior to the invention described herein, chemical syntheses of HMOS were possible, but were limited by stereo-specificity issues, precursor availability, product impurities, and high overall cost (Flowers, H. M. Methods Enzymol 50, 93-121 (1978); Seeberger, P. H. Chem Commun (Camb) 1115-1121 (2003); Koeller, K. M. & Wong, C. H. Chem Rev 100, 4465-4494 (2000)). The invention overcomes the shortcomings of these previous attempts by providing new strategies to inexpensively manufacture large quantities of human milk oligosaccharides (HMOS) for use as dietary supplements. Advantages include efficient expression of the enzyme, improved stability and/or solubility of the fucosylated oligosaccharide product (2'-FL, LDFT, LNF I, and LDFH I) and reduced toxicity to the host organism. The present invention features novel α(1,2) FTs suitable for expression in production strains for increased efficacy and yield of fucosylated HMOS compared to α(1,2) FTs currently utilized in the field.

As described in detail below, *E. coli* (or other bacteria) is engineered to produce selected fucosylated oligosaccharides (i.e., 2'-FL, LDFT, LDHF I, or LNF I) in commercially viable levels. For example, yields are >5 grams/liter in a bacterial fermentation process. In other embodiments, the yields are greater than 10 grams/liter, greater than 15 grams/liter, greater than 20 grams/liter, greater than 25 grams/liter, greater than 30 grams/liter, greater than 35 grams/liter, greater than 40 grams/liter, greater than 45 grams/liter, greater than 50 grams/liter, greater than 55 grams/liter, greater than 60 grams/liter, greater than 65 grams/liter, greater than 70 grams/liter, or greater than 75 grams/liter of fucosylated oligosaccharide products, such as 2'-FL, LDFT, LDHF I, and LNF I.

Role of Human Milk Glycans in Infectious Disease

Human milk glycans, which comprise both unbound oligosaccharides and their glycoconjugates, play a significant role in the protection and development of the infant gastrointestinal (GI) tract. Neutral fucosylated oligosaccharides, including 2'-fucosyllactose (2'-FL), protect infants against several important pathogens. Milk oligosaccharides found in various mammals differ greatly, and the composition in humans is unique (Hamosh M., 2001 Pediatr Clin North Am, 48:69-86; Newburg D. S., 2001 Adv Exp Med Biol, 501:3-10). Moreover, glycan levels in human milk change throughout lactation and also vary widely among individuals (Morrow A. L. et al., 2004 J Pediatr, 145:297-303; Chaturvedi P et al., 2001 Glycobiology, 11:365-372). Approximately 200 distinct human milk oligosaccharides have been identified and combinations of simple epitopes are responsible for this diversity (Newburg D. S., 1999 Curr_Med Chem, 6:117-127; Ninonuevo M. et al., 2006 J Agric Food Chem, 54:7471-74801).

Human milk oligosaccharides are composed of 5 monosaccharides: D-glucose (Glc), D-galactose (Gal), N-acetylglucosamine (GlcNAc), L-fucose (Fuc), and sialic acid (N-acetyl neuraminic acid, Neu5Ac, NANA). Human milk oligosaccharides are usually divided into two groups according to their chemical structures: neutral compounds containing Glc, Gal, GlcNAc, and Fuc, linked to a lactose (Galβ1-4Glc) core, and acidic compounds including the same sugars, and often the same core structures, plus NANA (Charlwood J. et al., 1999 Anal Biochem, 273:261-277; Martín-Sosa et al., 2003 J Dairy Sci, 86:52-59; Parkkinen J. and Finne J., 1987 Methods Enzymol, 138:289-300; Shen Z. et al., 2001 J Chromatogr A, 921:315-321).

Approximately 70-80% of oligosaccharides in human milk are fucosylated, and their synthetic pathways are believed to proceed as shown in FIG. 1. A smaller proportion of the oligosaccharides are sialylated or both fucosylated and sialylated, but their synthetic pathways are not fully defined. Understanding of the acidic (sialylated) oligosaccharides is limited in part by the ability to measure these compounds. Sensitive and reproducible methods for the analysis of both neutral and acidic oligosaccharides have been designed. Human milk oligosaccharides as a class survive transit through the intestine of infants very efficiently, being essentially indigestible (Chaturvedi, P., Warren, C. D., Buescher, C. R., Pickering, L. K. & Newburg, D. S. Adv Exp Med Biol 501, 315-323 (2001)).

Human Milk Glycans Inhibit Binding of Enteropathogens to their Receptors

Human milk glycans have structural homology to cell receptors for enteropathogens and function as receptor decoys. For example, pathogenic strains of *Campylobacter* bind specifically to glycans containing H-2, i.e., 2'-fucosyl-N-acetyllactosamine or 2'-fucosyllactose (2'FL); *Campylobacter* binding and infectivity are inhibited by 2'-FL and other glycans containing this H-2 epitope. Similarly, some diarrheagenic *E. coli* pathogens are strongly inhibited in vivo by human milk oligosaccharides containing 2-linked fucose moieties. Several major strains of human caliciviruses, especially the noroviruses, also bind to 2-linked fucosylated glycans, and this binding is inhibited by human milk 2-linked fucosylated glycans. Consumption of human milk that has high levels of these 2-linked fucosyloligosaccharides was associated with lower risk of norovirus, *Campylobacter*, ST of *E. coli*-associated diarrhea, and moderate-to-severe diarrhea of all causes in a Mexican cohort of breastfeeding children (Newburg D. S. et al., 2004 Glycobiology, 14:253-263; Newburg D. S. et al., 1998 Lancet, 351:1160-1164). Several pathogens utilize sialylated glycans as their host receptors, such as influenza (Couceiro, J. N., Paulson, J. C. & Baum, L. G. Virus Res 29, 155-165 (1993)), parainfluenza (Amonsen, M., Smith, D. F., Cummings, R. D. & Air, G. M. J Virol 81, 8341-8345 (2007), and rotoviruses (Kuhlenschmidt, T. B., Hanafin, W. P., Gelberg, H. B. & Kuhlenschmidt, M. S. Adv Exp Med Biol 473, 309-317 (1999)). The sialyl-Lewis X epitope is used by *Helicobacter pylori* (Mandavi, J., Sondén, B., Hurtig, M., Olfat, F. O., et al. Science 297, 573-578 (2002)), *Pseudomonas aeruginosa* (Scharfman, A., Delmotte, P., Beau, J., Lamblin, G., et al. Glycoconj J 17, 735-740 (2000)), and some strains of noroviruses (Rydell, G. E., Nilsson, J., Rodriguez-Diaz, J., Ruvoën-Clouet, N., et al. Glycobiology 19, 309-320 (2009)).

Identification of Novel α(1,2) Fucosyltransferases

The present invention provides novel α(1,2) fucosyltransferase enzymes. The present invention also provides nucleic acid constructs (i.e., a plasmid or vector) carrying the nucleic acid sequence of a novel α(1,2) fucosyltransferases for the expression of the novel α(1,2) fucosyltransferases in host bacterium. The present invention also provides methods for producing fucosylated oligosaccharides by expressing the novel α(1,2) fucosyltransferases in suitable host production bacterium, as further described herein.

Not all α(1,2)fucosyltransferases can utilize lactose as an acceptor substrate. An acceptor substrate includes, for example, a carbohydrate, an oligosaccharide, a protein or glycoprotein, a lipid or glycolipid, e.g., N-acetylglucosamine, N-acetyllactosamine, galactose, fucose, sialic acid, glucose, lactose, or any combination thereof. A preferred alpha (1,2) fucosyltransferase of the present invention utilizes GDP-fucose as a donor, and lactose is the acceptor for that donor.

A method of identifying novel α(1,2)fucosyltransferase enzymes capable of utilizing lactose as an acceptor was previously carried out (as described in PCT/US2013/051777, hereby incorporated by reference in its entirety) using the following steps: 1) performing a computational search of sequence databases to define a broad group of simple sequence homologs of any known, lactose-utilizing α(1,2)fucosyltransferase; 2) using the list of homologs from step 1 to derive a search profile containing common sequence and/or structural motifs shared by the members of the broad group, e.g. by using computer programs such as MEME (Multiple Em for Motif Elicitation available at http://meme.sdsc.edu/meme/cgi-bin/meme.cgi) or PSI-BLAST (Position-Specific Iterated BLAST available at ncbi.nlm.nih.gov/blast with additional information at cnx-.org/content/m11040/latest/); 3) searching sequence databases (e.g., using computer programs such as PSI-BLAST, or MAST (Motif Alignment Search Tool available at http://meme.sdsc.edu/meme/cgi-bin/mast.cgi); using this derived search profile as query, and identifying "candidate sequences" whose simple sequence homology to the original lactose-accepting α(1,2)fucosyltransferase is 40% or less; 4) scanning the scientific literature and developing a list of "candidate organisms" known to express α(1,2)fucosylglycans; 5) selecting only those "candidate sequences" that are derived from "candidate organisms" to generate a list of "candidate lactose-utilizing enzymes"; and 6) expressing each "candidate lactose-utilizing enzyme" and testing for lactose-utilizing α(1,2)fucosyltransferase activity.

The MEME suite of sequence analysis tools (meme.sdsc.edu/meme/cgi-bin/meme.cgi) can also be used as an alternative to PSI-BLAST. Sequence motifs are discovered using the program "MEME". These motifs can then be used to search sequence databases using the program "MAST". The BLAST and PSI-BLAST search algorithms are other well known alternatives.

Figure 3B:
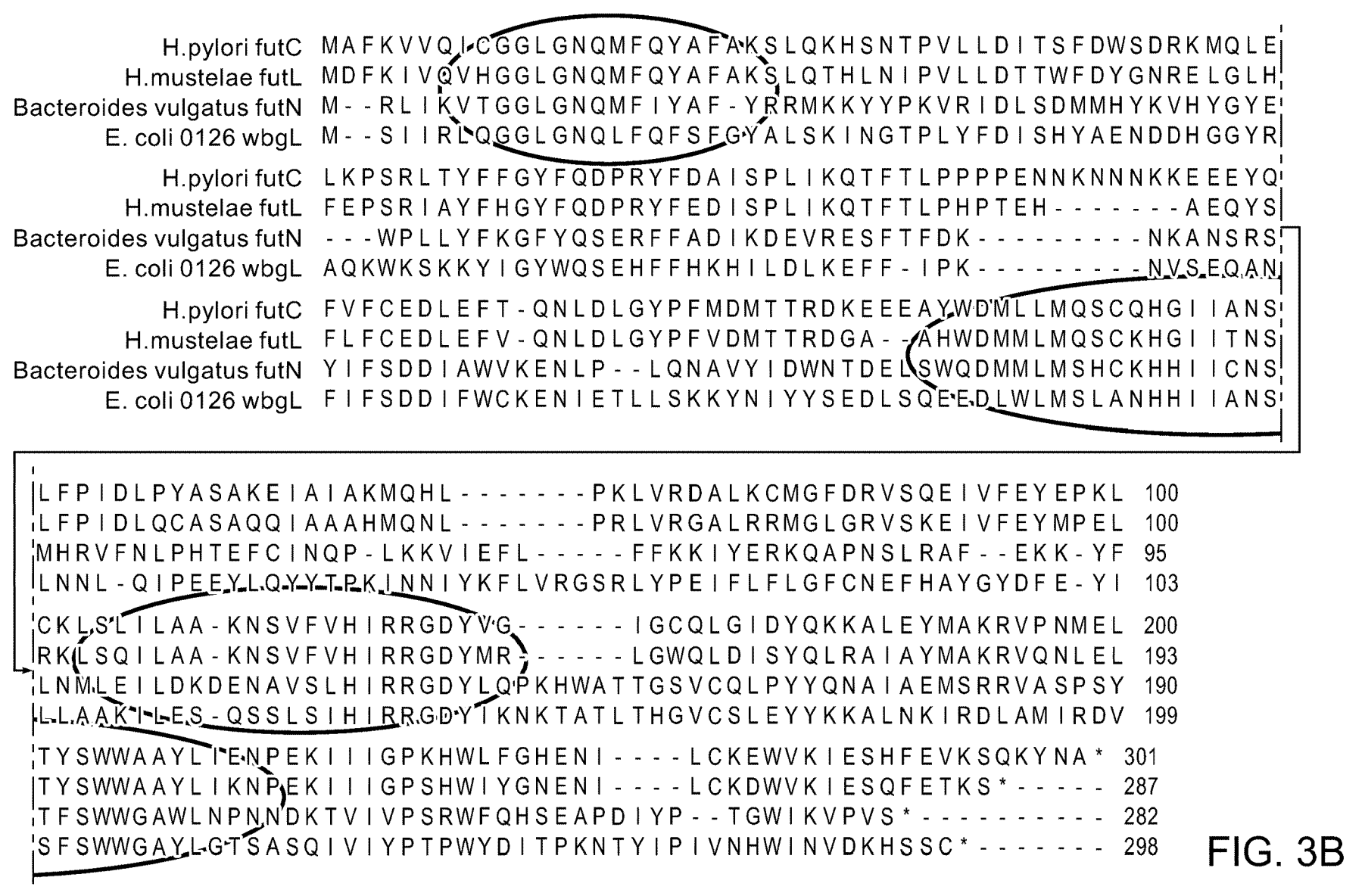

To identify additional novel α(1,2)fucosyltransferases, a multiple sequence alignment query was generated using four previously identified lactose-utilizing α(1,2)fucosyltransferase protein sequences: *H. pylori* futC (SEQ ID NO: 1), *H. mustelae* FutL (SEQ ID NO: 2), *Bacteroides vulgatus* futN (SEQ ID NO: 3), and *E. coli* O126 wbgL (SEQ ID NO: 4). These sequence alignment and percentage of sequence identity is shown in FIG. 3. An iterative PSI-BLAST was performed, using the FASTA-formatted multiple sequence alignment as the query, and the NCBI PSI-BLAST program run on a local copy of NCBI BLAST+ version 2.2.29. An initial position-specific scoring matrix file (.pssm) was generated by PSI-BLAST, which the program then used to adjust the score of iterative homology search runs. The process is iterated to generate an even larger group of candidates, and the results of each run were used to further refine the matrix.

This PSI-BLAST search resulted in an initial 2515 hits. There were 787 hits with greater than 22% sequence identity to FutC. 396 hits were of greater than 275 amino acids in length. Additional analysis of the hits was performed, including sorting by percentage identity to FutC, comparing the sequences by BLAST to existing α(1,2) fucosyltransferase inventory (of known α(1,2) fucosyltransferases), and manual annotation of hit sequences to identify those originating from bacteria that naturally exist in the gastrointestinal tract. An annotated list of the novel α(1,2) fucosyltransferases identified by this screen are listed in Table 1. Table 1 provides the bacterial species from which the candidate enzyme is found, the GenBank Accession Number, GI Identification Number, amino acid sequence, and % sequence identity to FutC.

Of the identified hits, 12 novel α(1,2) fucosyltransferases were further analyzed for their functional capacity: *Prevotella melaninogenica* FutO, *Clostridium bolteae* FutP, *Clostridium bolteae*+13 FutP, *Lachnospiraceae* sp. FutQ, *Methanosphaerula palustries* FutR, *Tannerella* sp. FutS, *Bacteroides caccae* FutU, *Butyrivibrio* FutV, *Prevotellaa* sp. FutW, *Parabacteroides johnsonii* FutX, *Akkermansia muciniphilia* FutY, *Salmonella enterica* FutZ, and *Bacteroides* sp. FutZA. For *Clostridium bolteae* FutP, the annotation named the wrong initiation methionine codon. Thus, the present invention includes FutP with an additional 13 amino acids at the N-terminus of the annotated FutP (derived in-frame from the natural upstream DNA sequence), which is designated herein as *Clostridium bolteae*+13 FutP. The sequence identity between the 12 novel α(1,2) fucosyltransferases identified and the 4 previously identified α(1,2) fucosyltransferases is shown in Table 2 below.

TABLE 2

| | | Sequence Identity | | | | | | | | | | | | | | | |
|---|---|---|---|---|---|---|---|---|---|---|---|---|---|---|---|---|---|
| | | 1 | 2 | 3 | 4 | 5 | 6 | 7 | 8 | 9 | 10 | 11 | 12 | 13 | 14 | 15 | 16 |
| *H. pylori* futC | 1 | | 70.10 | 21.99 | 20.82 | 27.68 | 27.36 | 23.56 | 23.26 | 23.62 | 25.75 | 23.72 | 24.05 | 12.29 | 24.19 | 22.92 | 22.29 |
| *H. mustelae* futL | 2 | 70.10 | | 23.87 | 19.88 | 26.38 | 28.21 | 24.30 | 23.38 | 24.62 | 25.31 | 25.31 | 24.47 | 23.56 | 25.15 | 23.55 | 23.26 |
| *Bacteroides vulgatus* futN | 3 | 21.99 | 23.87 | | 25.16 | 32.05 | 28.71 | 28.94 | 25.79 | 37.46 | 32.27 | 26.11 | 61.27 | 71.63 | 27.67 | 25.15 | 84.75 |
| *E. coli* O126 wbgL | 4 | 20.82 | 19.88 | 25.16 | | 24.25 | 22.73 | 22.32 | 26.04 | 25.45 | 24.77 | 21.49 | 73.29 | 26.71 | 24.63 | 21.45 | 25.16 |
| *Prevotella melaninogenica* FutO YP_003814512.1 | 5 | 27.68 | 26.36 | 32.05 | 24.25 | | 36.96 | 31.63 | 35.74 | 35.16 | 55.74 | 30.28 | 30.03 | 32.80 | 30.09 | 26.28 | 31.83 |
| *Clostridium bolteae* + 13 FutP WP_002570768.1 | 6 | 27.36 | 28.21 | 28.71 | 22.73 | 36.96 | | 37.87 | 35.10 | 33.77 | 36.91 | 35.74 | 29.53 | 31.39 | 27.67 | 26.33 | 29.13 |
| *Lachnospiraceae* sp. FutQ WP_009251343.1 | 7 | 23.56 | 24.30 | 28.94 | 22.32 | 31.63 | 37.87 | | 29.87 | 29.17 | 32.90 | 51.02 | 28.53 | 30.00 | 27.69 | 24.00 | 27.74 |
| *Methanospharula palustris* FutR YP_002467213.1 | 8 | 23.28 | 23.38 | 25.79 | 26.04 | 35.74 | 35.10 | 29.87 | | 18.71 | 38.24 | 31.41 | 25.39 | 28.08 | 30.65 | 23.93 | 25.55 |
| *Tannerella* sp. FutS WP_021929367.1 | 9 | 23.62 | 24.62 | 37.46 | 25.45 | 35.16 | 33.77 | 29.17 | 28.71 | | 34.41 | 30.03 | 35.71 | 36.27 | 26.48 | 21.75 | 36.60 |
| *Bacteroides caccae* FutU WP_005675707.1 | 10 | 25.75 | 25.31 | 32.27 | 24.77 | 55.74 | 36.91 | 32.90 | 38.24 | 34.41 | | 31.21 | 29.94 | 33.33 | 29.28 | 24.40 | 33.01 |
| *Butyrivibrio* FutV WP_022772718.1 | 11 | 23.72 | 25.31 | 25.11 | 21.49 | 30.28 | 35.74 | 51.02 | 31.41 | 30.03 | 31.21 | | 27.62 | 26.20 | 26.46 | 22.15 | 26.52 |
| *Prevotella* sp. FutV WP_022481266.1 | 12 | 24.05 | 24.47 | 61.27 | 23.29 | 30.03 | 29.58 | 28.53 | 25.39 | 15.71 | 29.94 | 27.62 | | 57.60 | 25.79 | 22.15 | 59.01 |
| *Parabacteroides johnsonni* FutX WP_008155883.1 | 13 | 22.29 | 23.56 | 71.63 | 26.71 | 32.80 | 31.39 | 30.00 | 28.08 | 36.27 | 33.33 | 26.20 | 57.60 | | 28.71 | 24.00 | 74.02 |
| *Akkermansia muciniphilia* FutY YP_00187755.5 | 14 | 24.19 | 25.15 | 27.67 | 24.63 | 30.09 | 27.67 | 27.69 | 30.65 | 26.41 | 29.28 | 26.46 | 25.79 | 28.71 | | 21.45 | 28.08 |
| *Salmonella enterica* FutZ WP_023214330 | 15 | 21.92 | 23.55 | 25.15 | 21.45 | 26.24 | 26.33 | 14.00 | 23.93 | 21.75 | 24.46 | 22.13 | 22.15 | 24.00 | 21.45 | | 74.62 |
| *Bacteroides* sp. FutZA WP_022161880.11 | 16 | 22.29 | 23.26 | 84.75 | 25.16 | 31.83 | 29.13 | 27.74 | 25.55 | 35.50 | 33.01 | 26.52 | 59.01 | 74.02 | 28.08 | 24.62 | |

Based on the amino acid sequences of the identified α(1,2) fucosyltransferases (i.e., in Table 1), syngenes can be readily designed and constructed by the skilled artisan using standard methods known in the art. For example, the syngenes include a ribosomal binding site, are codon-optimized for expression in a host bacterial production strain (i.e., *E. coli*), and have common 6-cutter restriction sites or sites recognized by endogenous restriction enzymes present in the host strain (i.e., EcoK restriction sites) removed to ease cloning and expression in the *E. coli* host strain. In a preferred embodiment, the syngenes are constructed with the following configuration: EcoRI site-T7g10 RBS-α(1,2) FT syngene-XhoI site. The nucleic acid sequences of sample syngenes for the 12 identified α(1,2) fucosyltransferases are shown in Table 3. (the initiating methionine ATG codon is bolded)

TABLE 3

Nucleic acid sequences of 12 novel a(1,2) fucosyltransferase syngenes

| Bacteria/<br>Gene<br>name | Sequence | SEQ<br>ID<br>NO: |
|---|---|---|
| FutO | CAGTCAGTCAGAATTCAAGAAGGAGATATACAATGAAAATCGTCAAAATCCTGGGCGGT<br>CTGGGCAATCAGATGTTCCAGTATGCTCTGTACCTGAGCCTGCAAGAAAGTTTTCCAAAA<br>GAACGTGTGGCCCTGGACCTGTCCTCCTTCCACGGCTATCACCTGCATAATGGCTTTGAG<br>CTGGAGAACATTTTCTCCGTTACCGCTCAGAAAGCATCCGCCGCAGATATCATGCGTATT<br>GCTTATTACTACCCGAACTATCTGCTGTGGCGCATTGGCAAACGTTTTCTGCCGCGTCGT<br>AAAGGTATGTGCCTGGAATCTAGCTCCCTGCGTTTCGATGAAAGCGTTCTGCGTCAGGAA<br>GGTAACCGTTATTTTGACGGTTACTGGCAAGACGAACGCTACTTCGCAGCCTATCGTGAA<br>AAAGTGCTGAAGGCTTTCACCTTTCCTGCATTCAAACGCGCAGAAAACCTGAGCCTGCTG<br>GAAAAACTGGACGAAAACAGCATTGCTCTGCATGTTCGTCGCGGTGATTACGTAGGTAAT<br>AACCCTGTACCAAGGCATCTGTGACCTGGACTACTACCGTACCGCTATCGAGAAAATGTGT<br>GCACACGTTACTCCGTCTCTGTTTTGTATCTTTTCCAACGACATCACGTGGTGCCAGCAG<br>CACCTGCAACCGTACCTGAAGGCCCCTGTGGTGTACGTTACTTGGAACACCGGTGTTGAA<br>TCCTACCGCGATATGCAGCTGATGTCCTGCTGCGCACATAACATCATCGCGAATAGCTCC<br>TTCTCTTGGTGGGGTGCTTGGCTGAATCAGAACCGTGAAAAAGTTGTTATCGCCCCGAAA<br>AAATGGCTGAACATGGAAGAATGTCACTTCACGCTGCCGGCAAGCTGGATCAAAATTTAG<br>CTCGAGTGACTGACTG | 276 |
| FutP | CAGTCAGTCAGAATTCAAGAAGGAGATATACAATGGTGATTATCAAAATGATGGGTGGT<br>CTGGGCAACCAGATGTTCCAGTATGCTACAAAGCATTCGAGCAGAAGCACATCGAT<br>GTGTATGCAGACCTGGCATGGTACAAAAACAAATCCGTGAAATTTGAACTGTACAACTTC<br>GGCATTAAAATCAACGTAGCATCCGAGAAAGACATCAACCGTCTGAGCGATTGCCAGGCG<br>GACTTTGTTTCCCGCATCCGCCGTAAAATCTTTGGTAAAAAAAAGAGCTTCGTATCTGAA<br>AAAAATGACTCCTGCTATGAAAACGACATCCTGCGTATGGACAACGTTTATCTGAGCGGT<br>TATTGGCAGACCGAAAAATACTTCTCTAACACGCGTGAGAAGCTGCTGGAGGATTATTCC<br>TTCGCTCTGGTAAACTCTCAGGTGTCCGAATGGGAAGACTCCATTCGCAACAAAAACAGC<br>GTTAGCATCCATATCCGTCGTGGTGATTATCTACAGGGCGAACTGTATGGTGGTATTTGC<br>ACCTCTCTGTACTACGCCGAAGCAATCGAGTACATTAAAATGCGTGTTCCGAACGCAAAA<br>TTCTTCGTTTTCTCTGATGACGTTGAATGGGTTAAACAGCAAGAAGACTTCAAAGGCTTC<br>GTAATCGTTGATCGCAACGAGTATTCTAGCGCTCTGTCCGATATGTACCTGATGTCCCTG<br>TGCAAGCATAACATTATTGCTAACTCCTCTTTCAGCTGGTGGGCAGCTTGGCTGAACCGT<br>AACGAAGAAAAAATTGTAATCGCGCCGCGCCGTTGGCTGAACGGCAAGTGCACCCCAGAT<br>ATCTGGTGTAAAAAATGGATTCGTATCTAGCTCGAGTGACTGACTG | 277 |
| FutQ | CAGTCAGTCAGAATTCAAGAAGGAGATATACAATGGTGATCGTACAGCTGAGCGGCGGT<br>CTGGGCAACCAGATGTTCGAATACGCGCTGTACCTGAGCCTGAAAGCAAAAGGCAAAGAA<br>GTGAAAATTGACGATGTTACGTGTTACGAGGGCCCTGGCACCCGTCCGCGTCAACTGGAT<br>GTTTTTGGTATCACGTACGATCGCGCGTCTCGTGAGGAGCTGACTGAGATGACGGACGCG<br>AGCATGGATGCGCTGTCTCGTGTTCGTCGCAAACTGACCGGTCGCCGCACTAAAGCGTAC<br>CGCGAACGCGACATCAACTTCGATCCACTGGTTATGGAAAAAGACCCGGCACTGCTGGAA<br>GGCTGTTTCCAGTCTGACAAATACTTTCGTGATTGCGAAGGCCGCGTGCGCGAACCGTAT<br>CGTTTCCGCGGCATTGAATCCGGCGCGTTCCCGCTGCCGGAAGACTATCTGCGCCTGGAA<br>AAGCAGATCGAAGATTGTCAGTCCGTATCCGTACACATCCGTCGTGGCGACTACCTGGAC<br>GAATCTCATGGTGGTCTGTACACCGGCATTTGTACTGAGGCGTACTATAAAGAGGCTTTT<br>GCTCGCATGGAACGTCTGGTTCCGGGCGCACGTTTCTTCCTGTTCTCTAACGATCCAGAA<br>TGGACTCGTGAGCACTTTGAGAGCAAGAACTGCGTTCTGGTTGAAGGTAGCACCGAAGAC<br>ACGGGTTACATGGACCTGTACCTGATGAGCCGCTGCCGCCACAATATTATTGCCAACTCT<br>TCTTTCAGCTGGTGGGCGCTTGGCTGAATGAGAACCCTGAGAAAAAAGTCATCGCACCG<br>GCTAAATGGCTGAACGGTCGTGAGTGCCGTGATATCTATACCGAACGCATGATTCGTCTG<br>TAGCTCGAGTGACTGACTG | 278 |
| FutR | CAGTCAGTCAGAATTCAAGAAGGAGATATACAATGATCATTGTTCGTCTGAAAGGCGGT<br>CTGGGCAACCAACTGTCTCAGTATGCACTGGGCCGTAAGATCGCGCATCTGCACAATACC<br>GAACTGAAACTGGACACCACTTGGTTCACCACTATCTCCTCCGACACTCCACGTACCTAC<br>CGTCTGAACAATTATAACATCATCGGCACTATTGCATCCGCAAAGGAAATCCAGCTGATC<br>GAACGTGGTCGCGCGCAAGGCCGTGGCTACCTGCTGTCTAAAATTTCTGATCTGCTGACT<br>CCGATGTACCGTCGTACCTACGTCCGTGAACGTATGCATACCTTCGATAAAGCTATCCTG<br>ACCGTTCCGGACAACGTGTACCTGGATGGTTACTGGCAGACCGAAAAGTACTTCAAAGAC<br>ATCGAAGAAATCCTGCGCCGTGAGGTTACGCTGAAAGATGAACCGGATAGCATCAACCTG<br>GAAATGGCTGAACGTATTCAGGCTTGCCACAGCGTTTCCCTGCACGTGCGTCGTGGCGAC<br>TACGTTTCCAACCCGACCACTCAACAATTCCACGGCTGTTGCTCCATTGACTACTACAAC<br>CGCGCTATCTCTCTGATTGAAGAAAAGTGGATGACCCGTCTTTCTTTATTTTTTCTGAC<br>GATCTGCCGTGGGCTAAAGAAAACCTGGACATCCCTGGCGAAAAAACCTTCGTTGCGCAT<br>AACGGCCCGGAAAAGAGTATTGCGATCTGTGGCTGATGTCTCTGTGCCAGCACCATATC | 279 |

TABLE 3-continued

Nucleic acid sequences of 12 novel a(1,2) fucosyltransferase syngenes

| Bacteria/<br>Gene<br>name | Sequence | SEQ<br>ID<br>NO: |
|---|---|---|
| | ATCGCAAACTCTTCTTTCAGCTGGTGGGGTGCCTGGCTGGGTCAAGACGCCGAAAAGATG<br>GTGATCGCGCCGCGTCGCTGGGCCCTGTCCGAGAGCTTTGACACTTCTGACATCATTCCG<br>GACTCTTGGATTACTATCTAGCTCGAGTGACTGACTG | |
| FutS | CAGTCAGTCAGAATTCAAGAAGGAGATATACATATGGTACGCATTGTGGAAATCATCGGC<br>GGTCTGGGTAACCAGATGTTCCAGTACGCATTCTCCCTGTACCTGAAAAACAAATCTCAC<br>ATCTGGGACCGTCTGTATGTGGACATCGAGGCGATGAAAACCTACGATCGTCACTATGGT<br>CTGGAACTGGAGAAAGTTTTCAATCTGAGCCTGTGTCCAATCTCTAACCGTCTGCACCGC<br>AACCTGCAAAACGCTCCTTCGCAAAACACTTTGTAAAGAGCCTGTACGAGCACTCTGAA<br>TGCGAGTTCGACGAACCGGTGTACCGTGGCCTGCGTCCTTATCGCTATTATCGCGGCTAC<br>TGGCAAAACGAAGGTTACTTCGTTGATATTGAACCGATGATCCGTGAGGCTTTTCAGTTC<br>AACGTTAACATCCTGAGCAAAAAGACTAAAGCGATCGCATCCAAAATGCGCCGTGAACTG<br>TCCGTATCTATCCATGTTCGCCGTGGTGATTACGAAAACCTGCCGGAAGCGAAAGCGATG<br>CATGGCGGTATTTGTTCTCTGGACTATTACCACAAAGCGATCGACTTCATCCGCCAGCGT<br>CTGGATAATAACATCTGTTTCTATCTGTTCTCCGACGATATCAATTGGGTAGAAGAAAAC<br>CTGCAACTGGAAAACCGTTGCATCATCGACTGGAACCAGGGCGAAGATAGCTGGCAGGAC<br>ATGTACCTGATGAGCTGCTGCCGCCACCACATTATCGCAAACAGCTCTTTCTCCTGGTGG<br>GCGGCATGGCTGAATCCAAACAAGAACAAAATCGTACTGACCCCGAACAAATGGTTCAAC<br>CATACTGACGCAGTGGGTATCGTCCCAAAGTCCTGGATTAAAATTCCTGTGTTTTAGCTC<br>GAGTGACTGACTG | 280 |
| FutU | CAGTCAGTCAGAATTCAAGAAGGAGATATACATATGAAAATCGTTAAAATCCTGGGCGGC<br>CTGGGTAACCAGATGTTTCAGTACGCCCTGTTCCTGTCTCTGAAAGAACGCTTCCCGCAT<br>GAACAGGTGATGATTGACACCAGCTGCTTCCGCAATTACCCACTGCACAACGGTTTCGAA<br>GTGGATCGTATCTTCGCCCAGAAAGCACCGGTTGCCTCTTGGCGTAACATCCTGAAGGTT<br>GCCTACCCGTACCCGAACTACCGTTTCTGGAAAATCGGTAAATACATCCTGCCTAAACGT<br>AAAACCATGTGTGTAGAGCGTAAAAACTTCAGCTTTGACGCCGCAGTCCTGACCCGTAAA<br>GGCGATTGCTACTATGATGGCTACTGGCAGCATGAGGAATATTTCTGTGATATGAAAGAA<br>ACGATTTGGGAGGCTTTCTCCTTCCCTGAGCCGGTTGATGGTCGTAACAAGGAGATCGGT<br>GCCCTGCTACAGGCATCTGATAGCGCTTCCCTGCACGTTCGTCGCGGTGACTACGTGAAC<br>CACCCACTGTTTCGTGGTATTTGTGACCTGGACTATTATAAACGTGCCATCCACTACATG<br>GAAGAACGCGTCAACCCACAGCTGTACTGCGTTTTCAGCAACGATATGGCCTGGTGCGAG<br>TCCCACCTGCGTGCACTGCTGCCAGGCAAAGAAGTAGTTTATGTTGACTGGAACAAGGGT<br>GCGGAATCTTACGTTGATATGCGTCTGATGAGCCTGTGCCGTCACAACATCATCGCTAAC<br>TCTTCTTTCAGCTGGTGGGCGCATGGCTGAACCGTAACCCGCAGAAAGTGGTGGTAGCG<br>CCCGGAACGTTGGATGAACAGCCCGATTGAAGACCCAGTGAGCGACAAATGGATTAAACTG<br>TAGCTCGAGTGACTGACTG | 281 |
| FutV | CAGTCAGTCAGAATTCAAGAAGGAGATATACATATGATCATCATCCAGCTGAAAGGTGGC<br>CTGGGCAACCAAATGTTCCAGTACGCGCTGTACAAATCCCTGAAAAAACGTGGTAAAGAA<br>GTTAAAATTGATGACAAAACTGGCTTCGTGAACGACAAACTGCGTATCCCGGTACTGTCC<br>CGTTGGGGTGTTGAGTACGATCGTGCAACCGACGAAGAGATTATTAACCTGACCGACTCC<br>AAAAATGGACCTGTTCTCTCGCATCCGCCGTAAACTGACTGGCCGCAAAACGTTCCGTATC<br>GACGAAGAATCCGGTAAATTCAACCCGGAAATCCTGGAAAAAGAAGAACGCTTATCTGGTG<br>GGTTATTGGCAGTGCGACAAGTACTTCGACGACAAAGATGTGGTTCGCGAAATTCGTGAA<br>GCGTTCGAGAAAAAACCGCAGGAGCTGATGACCGACGCCAGCTCTTGGTCTACTCTACAG<br>CAGATTGAATGCTGCGAGTCCGTATCCCTGCACGTACGTCGTACTGATTACGTGGACGAG<br>GAACATATTCATATCCATAACATCTGTACGGAAAAATACTATAAAACGCATTGATCGT<br>GTGCGTAAACAGTACCCGAGCGCAGTGTTCTTCATCTTCACCGATGATAAAGAATGGTGC<br>CGCGACCACTTTAAAGGTCCGAACTTCATCGTAGTCGAACTGGAAGAAGGCGACGGTACC<br>GACATCGCTGAAATGACTCTGATGTCCCGCTGTAAACATCACATCATCGCTAATTCTAGC<br>TTTAGCTGGTGGGCGGCGTGGCTGAACGACTCCCCGGAPAAAATCGTGATCGCTCCTCAG<br>AAATGGATTAACAACCGCGACATGGACGATATTTACACCGAGCGTATGACTAAAATCGCA<br>CTGTAGCTCGAGTGACTGACTG | 282 |
| FutW | CAGTCAGTCAGAATTCAAGAAGGAGATATACATATGCGCCTGGTTAAAATGATCGGCGGT<br>CTGGGTAATCAGATGTTCATCTACGCGTTTTACCTACAGATGCGTAAGCGTTTCTCCAAC<br>GTTCGTATCGACCTGACCGATATGATGCACTACAACGTACACTATGGCTACGAACTGCAC<br>AAAGTTTTCGGTCTGCCGCGCACCGAGTTCTGTATGAACCAGCCTCTGAAAAGGTTCTG<br>GAGTTCCTGTTCTTCCGTACCATTGTTGAACGTAAACAGCACGGTCGTATGGAGCCGTAT<br>ACTTGCCAGTATGTTTGGCCGCTGGTTTACTTTAAGGGCTTCTATCAGTCCGAACGTTAC<br>TTCTCCGAAGTTAAGGACGAAGTTCGTGAGTGTTTCACCTTCAATCCGGCACTGGCGAAT<br>CGTTCTTCCCAACAGATGATGGAACAGATCCAGAATGATCCTCAGGCTGTCTCTATCCAC<br>ATCCGTCGTGGCGACTATCTGAATCCGAAGCACTACGACACTATCGGTTGTATCTGTCAG<br>CTGCCGTATTACAAGCACGCCGTTTCCGAAATTAAAAAGTACGTTTCTAACCCTCACTTT<br>TACGTTTTCTCCGAAGACCTGGATTGGGTCAAAGCAAACCTGCCGCTGGAAAACGCACAG<br>TACATCGATTGGAACAAAGGCGCAGATAGCTGGCAGGATATGATGCTGATGAGCTGTTGC<br>AAACACCACATTATCTGTAACTCCACCTTTAGCTGGTGGCGGCGTGGCTGAACCCATCT<br>GTCGAAAAACCGTGATCATGCCGGAACAGGTGGACGTCTCGTCAAGATTCCGTGGACTTT<br>GTGGCTAGCTGTGGCCGTTGGGTCCGTGTTAAAACGGAGTAGCTCGAGTGACTGACTG | 283 |
| FutX | CAGTCAGTCAGAATTCAAGAAGGAGATATACATATGCGTCTGATCAAGATGATCGGCGGC<br>CTGGGTAACCAGATGTTTATCTACGCGTTCTACCTGAAAATGAAACACCATTACCCGGAT<br>ACGAACATCGATCTGTCTGACATGGTTCATTATAAAGTTCACAACGGTTATGAGATGAAC | 284 |

TABLE 3-continued

Nucleic acid sequences of 12 novel α(1,2) fucosyltransferase syngenes

| Bacteria/<br>Gene<br>name | Sequence | SEQ<br>ID<br>NO: |
|---|---|---|
| | CGTATCTTTGACCTGAGCCAGACTGAATTTTGCATCAACCGTACCCTGAAAAAAATCCTG<br>GAGTTCCTGTTCTTCAAAAAAATCTACGAACGTCGCCAGGACCCGTCTACTCTGTATCCA<br>TACGAAAAACGTTATTTTTGGCCGCTGCTGTACTTTAAAGGTTTCTACCAGTCTGAACGC<br>TTCTTCTTCGATATCAAAGACGACGTTCGTAAAGCCTTCTCTTTTAACCTGAACATCGCT<br>AACCCGGAAAGCCTGGAACTGCTGAAACAGATCGAAGTTGACGACCAAGCTGTTTCTATC<br>CACATCCGCCGTGGTGACTACCTGCTGCCGCGTCACTGGGCAAACACGGGTTCCGTGTGC<br>CAGCTGCCGTATTACAAGAACGCGATCGCGGAAATGGAGAACCGTATTACTGGCCCGAGC<br>TACTACGTGTTCTCTGATGATATCTCTTGGGTTAAAGAAAACATCCCGCTGAAGAAAGCG<br>GTCTACGTGACGTGGAACAAGGGCGAAGACAGCTGGCAGGATATGATGCTGATGAGCCAC<br>TGTCGTCACCACATTATCTGTAATTCTACGTTCTCCTGGTGGGGTGCTTGGCTGAACCCA<br>CGTAAAGAGAAATCGTCATCGCGCCGTGTCGCTGGTTCCAGCATAAAGAAACCCCGGAC<br>ATGTACCCGAAAGAATGGATCAAAGTACCGATTAACTAGCTCGAGTGACTGACTG | |
| FutZ | CAGTCAGTCAGAATTCAAGAAGGAGATATACAATGTATTCTTGCCTGTCTGGTGGCCTG<br>GGTAACCAAATGTTTCAATACGCAGCAGCGTATATCCTGAAGCAGTATTTTCAGTCTACC<br>ACTCTGGTCCTGGATGATAGCTATTACTATTCCCAGCCGAAACGTGATACCGTTCGTAGC<br>CTGGAACTGAATCAGTTCAACATCTCTTATGATCGTTTTAGCTTCGCGGATGAAAAAGAG<br>AAGATCAAACTGCTGCGCAAATTCAAACGTAACCCGTTCCCTAAACAGATTTCCGAGATC<br>CTGTCTATTGCGCTGTTCGGCAAATACGCGCTGTCCGACCGTGCATTTTACACCTTCGAA<br>ACTATCAAAAACATCGACAAAGCGTGCCTGTTCTCCTTTTACCAGGACGCCGATCTGCTG<br>AATAAATATAAGCAGCTGATCCTGCCGCTGTTCGAACTGCGCGATGACCTGCTGGATATC<br>TGCAAGAACCTGGAACTGTATTCCCTGATCCAACGCAGCAACAATACCACTGCACTGCAT<br>ATCCGCCGTGGCGACTACGTGACCAACCAGCACGCCGCGAAATACCACGGCGTGCTGGAC<br>ATCAGCTACTATAACCACGCAATGGAATACGTGGAACGTGAACGCGGCAAACAGAACTTC<br>ATTATCTTCAGCGATGATGTACGTTGGGCACAGAAAGCGTTTCTGGAGAACGATAATTGC<br>TACGTGATTAACAACTCCGACTACGATTTCTCTGCGATCGATATGTATCTGATGTCTCTG<br>TGCAAAAACAACATCATCGCAAATTCCACCTACTCCTGGTGGGGTGCGTGGCTGAACAAA<br>TACGAGGACAAACTGGTTATCTCTCCGAAACAATGGTTTCTGGGTAACAACGAAACCTCT<br>CTGCGTAACGCGTCTTGGATCACCCTGTAGCTCGAGTGACTGACTG | 285 |
| FutZA | CAGTCAGTCAGAATTCAAGAAGGAGATATACAATGCGTCTGATCAAGATGACCGGTGGC<br>CTGGGTAACCAGATGTTCATCTACGCGTTTTATCTGCGTATGAAAAAACGTTATCCGAAA<br>GTTCGTATTGATCTGTCTGATATGGTTCATTATCACGTTCACCACGGCTATGAAATGCAC<br>CGTGTTTTCAATCTGCCGCACACCGAATTTTGCATCAACCAGCCGCTGAAAAAAGTGATC<br>GAGTTCCTGTTTTTCAAAAAGATTTACGAACGTAAACAGGACCCTAATTCTCTGCGTGCA<br>TTCGAGAAGAAGTATCTGTGGCCGCTGCTGTACTTCAAAGGTTTCTATCAATCTGAGCGC<br>TTCTTTGCTGACATCAAAGACGAGGTTCGTAAAGCATTCACCTTTGACTCTTCTAAAGTG<br>AACGCTCGCTCTGCCGAACTGCTGCGTCGCCTGGATGCCGATGCTAACGCGGTTAGCCTG<br>CACATTCGTCGCGGTGACTATCTACAGCCGCAGCATTGGGCTACCACTGGTTCTGTCTGC<br>CAGCTGCCGTACTACCAGAACGCGATCGCTGAAATGAACCGTCGCGTTGCTGCCCCGAGC<br>TACTACGTTTTCAGCGATGACATCGCGTGGGTGAAGGAAAACATCCCTCTACAGAACGCA<br>GTGTACATCGACTGGAATAAAGGCGAAGAAAGCTGGCAGGATATGATGCTGATGAGCCAC<br>TGCCGCCACCACATTATCTGTAACAGCACCTTCTCTTGGTGGGCGCGTGGCTGGACCCG<br>CACGAGGACAAAATTGTAATCGTTCCGAATCGTTGGTTCCAGCATTGCGAAACTCCTAAC<br>ATCTATCCGGCAGGCTGGGTGAAAGTTGCGATTAATTAGCTCGAGTGACTGACTG | 286 |

In any of the methods described herein, the α(1,2) fucosyltransferase genes or gene products may be variants or functional fragments thereof. A variant of any of genes or gene products disclosed herein may have 50%, 55%, 60%, 65%, 70%, 75%, 80%, 85%, 90%, 95%, 96%, 97%, 98%, or 99% sequence identity to the nucleic acid or amino acid sequences described herein.

Variants as disclosed herein also include homolog, orthologs, or paralogs of the genes or gene products described herein that retain the same biological function as the genes or gene products specified herein. These variants can be used interchangeably with the genes recited in these methods. Such variants may demonstrate a percentage of homology or identity, for example, 50%, 55%, 60%, 65%, 70%, 75%, 80%, 85%, 90%, 95%, 96%, 97%, 98%, or 99% identity conserved domains important for biological function, preferably in a functional domain, e.g. catalytic domain.

The term "% identity," in the context of two or more nucleic acid or polypeptide sequences, refer to two or more sequences or subsequences that are the same or have a specified percentage of amino acid residues or nucleotides that are the same, when compared and aligned for maximum correspondence, as measured using one of the following sequence comparison algorithms or by visual inspection. For example, % identity is relative to the entire length of the coding regions of the sequences being compared, or the length of a particular fragment or functional domain thereof.

For sequence comparison, typically one sequence acts as a reference sequence, to which test sequences are compared. When using a sequence comparison algorithm, test and reference sequences are input into a computer, subsequence coordinates are designated, if necessary, and sequence algorithm program parameters are designated. The sequence comparison algorithm then calculates the percent sequence identity for the test sequence(s) relative to the reference sequence, based on the designated program parameters.

Percent identity is determined using search algorithms such as BLAST and PSI-BLAST (Altschul et al., 1990, J Mol Biol 215:3, 403-410; Altschul et al., 1997, Nucleic Acids Res 25:17, 3389-402). For the PSI-BLAST search, the following exemplary parameters are employed: (1) Expect threshold was 10; (2) Gap cost was Existence:11 and Extensional; (3) The Matrix employed was BLOSUM62; (4) The filter for low complexity regions was "on".

Changes can be introduced by mutation into the nucleic acid sequence or amino acid sequence of any of the genes or gene products described herein, leading to changes in the amino acid sequence of the encoded protein or enzyme, without altering the functional ability of the protein or enzyme. For example, nucleotide substitutions leading to amino acid substitutions at "non-essential" amino acid residues can be made in the sequence of any of sequences expressly disclosed herein. A "non-essential" amino acid residue is a residue at a position in the sequence that can be altered from the wild-type sequence of the polypeptide without altering the biological activity, whereas an "essential" amino acid residue is a residue at a position that is required for biological activity. For example, amino acid residues that are conserved among members of a family of proteins are not likely to be amenable to mutation. Other amino acid residues, however, (e.g., those that are poorly conserved among members of the protein family) may not be as essential for activity and thus are more likely to be amenable to alteration. Thus, another aspect of the invention pertains to nucleic acid molecules encoding the proteins or enzymes disclosed herein that contain changes in amino acid residues relative to the amino acid sequences disclosed herein that are not essential for activity (i.e., fucosyltransferase activity).

An isolated nucleic acid molecule encoding a protein essentially retaining the functional capability compared to any of the genes described herein can be created by introducing one or more nucleotide substitutions, additions or deletions into the corresponding nucleotide sequence, such that one or more amino acid substitutions, additions or deletions are introduced into the encoded protein.

Mutations can be introduced into a nucleic acid sequence by standard techniques such that the encoded amino acid sequence is altered, such as site-directed mutagenesis and PCR-mediated mutagenesis. Preferably, conservative amino acid substitutions are made at one or more predicted nonessential amino acid residues. A "conservative amino acid substitution" is one in which the amino acid residue is replaced with an amino acid residue having a similar side chain. Families of amino acid residues having similar side chains have been defined in the art. Certain amino acids have side chains with more than one classifiable characteristic. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, tryptophan, cysteine), nonpolar side chains (e.g., alanine, valine, leucine, isoleucine, proline, phenylalanine, methionine, tyrosine, tryptophan), beta-branched side chains (e.g., threonine, valine, isoleucine) and aromatic side chains (e.g., tyrosine, phenylalanine, tryptophan, histidine). Thus, a predicted nonessential amino acid residue in a given polypeptide is replaced with another amino acid residue from the same side chain family. Alternatively, in another embodiment, mutations can be introduced randomly along all or part of a given coding sequence, such as by saturation mutagenesis, and the resultant mutants can be screened for given polypeptide biological activity to identify mutants that retain activity. Conversely, the invention also provides for variants with mutations that enhance or increase the endogenous biological activity. Following mutagenesis of the nucleic acid sequence, the encoded protein can be expressed by any recombinant technology known in the art and the activity of the protein can be determined. An increase, decrease, or elimination of a given biological activity of the variants disclosed herein can be readily measured by the ordinary person skilled in the art, i.e., by measuring the capability for mediating oligosaccharide modification, synthesis, or degradation (via detection of the products).

The present invention also provides for functional fragments of the genes or gene products described herein. A fragment, in the case of these sequences and all others provided herein, is defined as a part of the whole that is less than the whole. Moreover, a fragment ranges in size from a single nucleotide or amino acid within a polynucleotide or polypeptide sequence to one fewer nucleotide or amino acid than the entire polynucleotide or polypeptide sequence. Finally, a fragment is defined as any portion of a complete polynucleotide or polypeptide sequence that is intermediate between the extremes defined above.

For example, fragments of any of the proteins or enzymes disclosed herein or encoded by any of the genes disclosed herein can be 10 to 20 amino acids, 10 to 30 amino acids, 10 to 40 amino acids, 10 to 50 amino acids, 10 to 60 amino acids, 10 to 70 amino acids, 10 to 80 amino acids, 10 to 90 amino acids, 10 to 100 amino acids, 50 to 100 amino acids, 75 to 125 amino acids, 100 to 150 amino acids, 150 to 200 amino acids, 200 to 250 amino acids, 250 to 300 amino acids, 300 to 350 amino acids, 350 to 400 amino acids, 400 to 450 amino acids, or 450 to 500 amino acids. The fragments encompassed in the present invention comprise fragments that retain functional fragments. As such, the fragments preferably retain the catalytic domains that are required or are important for functional activity. Fragments can be determined or generated by using the sequence information herein, and the fragments can be tested for functional activity using standard methods known in the art. For example, the encoded protein can be expressed by any recombinant technology known in the art and the activity of the protein can be determined. The biological function of said fragment can be measured by measuring ability to synthesize or modify a substrate oligosaccharide, or conversely, to catabolize an oligosaccharide substrate.

Within the context of the invention, "functionally equivalent", as used herein, refers to a gene or the resulting encoded protein variant or fragment thereof capable of exhibiting a substantially similar activity as the wild-type fucosyltransferase. Specifically, the fucosyltransferase activity refers to the ability to transfer a fucose sugar to an acceptor substrate via an alpha-(1,2)-linkage. As used herein, "substantially similar activity" refers to an activity level within 5%, 10%, 20%, 30%, 40%, or 50% of the wild-type fucosyltransferase.

To test for lactose-utilizing fucosylatransferase activity, the production of fucosylated oligossacharides (i.e., 2'-FL) is evaluated in a host organism that expresses the candidate enzyme (or syngene) and which contains both cytoplasmic GDP-fucose and lactose pools. The production of fucosylated oligosaccharides indicates that the candidate enzyme-encoding sequence functions as a lactose-utilizing α(1,2) fucosyltransferase.

Engineering of E. coli to Produce Human Milk Oligosaccharide 2'-FL

Described herein is a gene screening approach, which was used to validate the novel α (1,2) fucosyltransferases (α (1,2) FTs) for the synthesis of fucosyl-linked oligosaccharides in metabolically engineered E. coli. Of particular interest are α (1,2) FTs that are capable of the synthesis of the HMOS 2'-fucosyllactose (2'-FL). 2'-FL is the most abundant fucosylated oligosaccharide present in human milk, and this oligosaccharide provides protection to newborn infants against infectious diarrhea caused by bacterial pathogens such as *Campylobacter jejuni* (Ruiz-Palacios, G. M., et al. (2003). J Biol Chem 278, 14112-120; Morrow, A. L. et al. (2004). J Pediatr 145, 297-303; Newburg, D. S. et al. (2004). Glycobiology 14, 253-263). Other α (1,2) FTs of interest are those capable of synthesis of HMOS lactodifucotetraose (LDFT), laco-N-fucopentaose I (LNFI), or lacto-N-difucohexaose I (LDFH I).

The synthetic pathway of fucosyl oligosaccharides of human milk is illustrated in FIG. 1. Structurally, 2'-FL consists of a fucose molecule a 1,2 linked to the galactose portion of lactose (Fucα1-2Galβ1-4Glc). An α (1,2) FT from *H. pylori* strain 26695 termed FutC has been utilized to catalyze the synthesis of 2'-FL in metabolically engineered *E. coli* (Drouillard, S. et al. (2006). Angew Chem Int Ed Engl 45, 1778-780).

Candidate α(1,2) FTs (i.e., syngenes) were cloned by standard molecular biological techniques into an expression plasmid. This plasmid utilizes the strong leftwards promoter of bacteriophage λ (termed $P_L$) to direct expression of the candidate genes (Sanger, F. et al. (1982). J Mol Biol 162, 729-773). The promoter is controllable, e.g., a trp-cI construct is stably integrated the into the *E. coli* host's genome (at the ampC locus), and control is implemented by adding tryptophan to the growth media. Gradual induction of protein expression is accomplished using a temperature sensitive cI repressor. Another similar control strategy (temperature independent expression system) has been described (Mieschendahl et al., 1986, Bio/Technology 4:802-808). The plasmid also carries the *E. coli* rcsA gene to up-regulate GDP-fucose synthesis, a critical precursor for the synthesis of fucosyl-linked oligosaccharides. In addition, the plasmid carries a β-lactamase (bla) gene for maintaining the plasmid in host strains by ampicillin selection (for convenience in the laboratory) and a native thyA (thymidylate synthase) gene as an alternative means of selection in thyA⁻ hosts. Alternative selectable markers include the proBA genes to complement proline auxotrophy (Stein et al., (1984), J Bacteriol 158:2, 696-700 (1984) or purA to complement adenine auxotrophy (S. A. Wolfe, J. M. Smith, J Biol Chem 263, 19147-53 (1988)). To act as plasmid selectable markers each of these genes are first inactivated in the host cell chromosome, then wild type copies of the genes are provided on the plasmid. Alternatively a drug resistance gene may be used on the plasmid, e.g. beta-lactamase (this gene is already on the expression plasmid described above, thereby permitting selection with ampicillin). Ampicillin selection is well known in the art and described in standard manuals such as Maniatis et al., (1982) Molecular cloning, a laboratory manual. Cold Spring Harbor Laboratory, Cold Spring, N.Y.

The nucleic acid sequence of such an expression plasmid, pEC2-(T7)FutX-rcsA-thyA (pG401) is provided below. The underlined sequence represents the FutX syngene, which can be readily replaced with any of the novel α(1,2) FTs described herein using standard recombinant DNA techniques.

(SEQ ID NO: 287)
```
TCGCGCGTTTCGGTGATGACGGTGAAAACCTCTGACACATGCAGCTCCCG
GAGACGGTCACAGCTTGTCTGTAAGCGGATGCCGGGAGCAGACAAGCCCG
TCAGGGCGCGTCAGCGGGTGTTGGCGGGTGTCGGGGCTGGCTTAACTATG
CGGCATCAGAGCAGATTGTACTGAGAGTGCACCATATATGCGGTGTGAAA
TACCGCACAGATGCGTAAGGAGAAAATACCGCATCAGGCGCCTCCTCAAC
CTGTATATTCGTAAACCACGCCCAATGGGAGCTGTCTCAGGTTTGTTCCT
GATTGGTTACGGCGCGTTTCGCATCATTGTTGAGTTTTTCCGCCAGCCCG
ACGCGCAGTTTACCGGTGCCTGGGTGCAGTACATCAGCATGGGGCAAATT
CTTTCCATCCCGATGATTGTCGCGGGTGTGATCATGATGGTCTGGGCATA
TCGTCGCAGCCCACAGCAACACGTTTCCTGAGGAACCATGAAACAGTATT
TAGAACTGATGCAAAAAGTGCTCGACGAAGGCACACAGAAAAACGACCGT
ACCGGAACCGGAACGCTTTCCATTTTTGGTCATCAGATGCGTTTTAACCT
GCAAGATGGATTCCCGCTGGTGACAACTAAACGTTGCCACCTGCGTTCCA
TCATCCATGAACTGCTGTGGTTTCTGCAGGGCGACACTAACATTGCTTAT
CTACACGAAACAATGTCACCATCTGGGACGAATGGGCCGATGAAAACGG
CGACCTCGGGCCAGTGTATGGTAAACAGTGGCGCGCCTGGCCAACGCCAG
ATGGTCGTCATATTGACCAGATCACTACGGTACTGAACCAGCTGAAAAAC
GACCCGGATTCGCGCCGCATTATTGTTCAGCGTGGAACGTAGGCGAACT
GGATAAAATGGCGCTGGCACCGTGCCATGCATTCTTCCAGTTCTATGTGG
CAGACGGCAAACTCTCTTGCCAGCTTTATCAGCGCTCCTGTGACGTCTTC
CTCGGCCTGCCGTTCAACATTGCCAGCTACGCGTTATTGGTGCATATGAT
GGCGCAGCAGTGCGATCTGGAAGTGGGTGATTTTGTCTGGACCGGTGGCG
ACACGCATCTGTACAGCAACCATATGGATCAAACTCATCTGCAATTAAGC
CGCGAACCGCGTCCGCTGCCGAAGTTGATTATCAAACGTAAACCCGAATC
CATCTTCGACTACCGTTTCGAAGACTTTGAGATTGAAGGCTACGATCCGC
ATCCGGGCATTAAAGCGCCGGTGGCTATCTAATTACGAAACATCCTGCCA
GAGCCGACGCCAGTGTGCGTCGGTTTTTTTACCCTCCGTTAAATTCTTCG
AGACGCCTTCCCGAAGGCGCCATTCGCCATTCAGGCTGCGCAACTGTTGG
GAAGGGCGATCGGTGCGGGCCTCTTCGCTATTACGCCAGCTGGCGAAAGG
GGGATGTGCTGCAAGGCGATTAAGTTGGGTAACGCCAGGGTTTTCCCAGT
CACGACGTTGTAAAACGACGGCCAGTGCCAAGCTTTCTTTAATGAAGCAG
GGCATCAGGACGGTATCTTTGTGGAGAAAGCAGAGTAATCTTATTCAGCC
TGACTGGTGGGAAACCACCAGTCAGAATGTGTTAGCGCATGTTGACAAAA
ATACCATTAGTCACATTATCCGTCAGTCGGACGACATGGTAGATAACCTG
TTTATTATGCGTTTTGATCTTACGTTTAATATTACCTTTATGCGATGAAA
CGGTCTTGGCTTTGATATTCATTTGGTCAGAGATTTGAATGGTTCCCTGA
CCTGCCATCCACATTCGCAACATACTCGATTCGGTTCGGCTCAATGATAA
CGTCGGCATATTTAAAAACGAGGTTATCGTTGTCTCTTTTTTCAGAATAT
CGCCAAGGATATCGTCGAGAGATTCCGGTTTAATCGATTTAGAACTGATC
AATAAATTTTTCTGACCAATAGATATTCATCAAAATGAACATTGGCAAT
TGCCATAAAAACGATAAATAACGTATTGGGATGTTGATTAATGATGAGCT
TGATACGCTGACTGTTAGAAGCATCGTGGATGAAACAGTCCTCATTAATA
AACACCACTGAAGGGCGCTGTGAATCACAAGCTATGGCAAGGTCATCAAC
GGTTTCAATGTCGTTGATTTCTCTTTTTTTAACCCCTCTACTCAACAGAT
ACCCGGITAAACCTAGTCGGGTGTAACTACATAAATCCATAATAATCGTT
```

-continued

```
GACATGGCATACCCTCACTCAATGCGTAACGATAATTCCCCTTACCTGAA

TATTTCATCATGACTAAACGGAACAACATGGGTCACCTAATGCGCCACTC

TCGCGATTTTTCAGGCGGACTTACTATCCCGTAAAGTGTTGTATAATTTG

CCTGGAATTGTCTTAAAGTAAAGTAAATGTTGCGATATGTGAGTGAGCTT

AAAACAAATATTTCGCTGCAGGAGTATCCTGGAAGATGTTCGTAGAAGCT

TACTGCTCACAAGAAAAAAGGCACGTCATCTGACGTGCCTTTTTTATTTG

TACTACCCTGTACGATTACTGCAGCTCGAGCTAGTTAATCGGTACTTTGA

TCCATTCTTTCGGGTACATGTCCGGGGTTTCTTTATCCTGGAACCAGCGA

CACGGCGCGATGACGATTTTCTCTTTACGTGGGTTCAGCCAAGCACCCCA

CCAGGAGAACGTAGAATTACAGATAATGTGGTGACGACAGTGGCTCATCA

GCATCATATCCTGCCAGCTGTCTTCGCCCTTGTTCCACGTCACGTAGACC

GCTTTCTTCAGCGGATGTTTTCTTTAACCCAAGAGATATCATCAGAGAA

CACGTAGTAGCTCGGGCCAGTAATACGGTTCTCCATTTCCGCGATCGCGT

TCTTGTAATACGGCAGCTGGCACACGGAACCCGTGTTTGCCCAGTGACGC

GGCACCAGGTAGTCACCACGGCGGATGTGGATAGAAACAGCTTCGTCGTC

AACTTCGATCTGTTTCAGCAGTTCCAGGCTTTCCGGGTTAGCGATGTTCA

GGTTAAAAGAGAAGGCTTTACGAACGTCGTCTTTGATATCGAAGAAGAAG

CGTTCAGACTGGTAGAAACCTTTAAAGTACAGCAGCGGCCAAAAATAACG

TTTTTCGTATGGATACAGAGTAGACGCGTCCTGGCCACGTTCGTAGATTT

TTTTGAAGAACAGGAACTCCAGGATTTTTTTCAGGGTACGGTTGATGCAA

AATTCAGTCGGCTCAGGTCAAAGATACGGTTCATCTCATAACCGTTGTG

AACTTTATAATGAACCATGTCAGACAGATCGATGTTCGTATCCGGGTAAT

GGTGTTTCATTTTCAGGTAGAACGCGTAGATAAACATCTGGTTACCCAGG

CCGCCGATCATCTTGATCAGACGCATATGTATATCTCCTTCTTGAATTCT

AAAAATTGATTGAATGTATGCAAATAAATGCATACACCATAGGTGTGGTT

TAATTTGATGCCCTTTTTCAGGGCTGGAATGTGTAAGAGCGGGGTTATTT

ATGCTGTTGTTTTTTGTTACTCGGGAAGGGCTTTACCTCTTCCGCATAA

ACGCTTCCATCAGCGTTTATAGTTAAAAAAATCTTTCGGAACTGGTTTTG

CGCTTACCCCAACCAACAGGGGATTTGCTGCTTTCCATTGAGCCTGTTTC

TCTGCGCGACGTTCGCGGCGGCGTGTTTGTGCATCCATCTGGATTCTCCT

GTCAGTTAGCTTTGGTGGTGTGTGGCAGTTGTAGTCCTGAACGAAACCC

CCCGCGATTGGCACATTGGCAGCTAATCCGGAATCGCACTTACGGCCAAT

GCTTCGTTTCGTATCACACACCCCAAAGCCTTCTGCTTTGAATGCTGCCC

TTCTTCAGGGCTTAATTTTTAAGAGCGTCACCTTCATGGTGGTCAGTGCG

TCCTGCTGATGTGCTCAGTATCACCGCCAGTGGTATTTATGTCAACACCG

CCAGAGATAATTTATCACCGCAGATGGTTATCTGTATGTTTTTTATATGA

ATTTATTTTTTGCAGGGGGCATTGTTTGGTAGGTGAGAGATCAATTCTG

CATTAATGAATCGGCCAACGCGCGGGAGAGGCGGTTTGCGTATTGGGCG

CTCTTCCGCTTCCTCGCTCACTGACTCGCTGCGCTCGGTCGTTCGGCTGC

GGCGAGCGGTATCAGCTCACTCAAAGGCGGTAATACGGTTATCCACAGAA

TCAGGGGATAACGCAGGAAAGAACATGTGAGCAAAAGGCCAGCAAAAGGC

CAGGAACCGTAAAAAGGCCGCGTTGCTGGCGTTTTTCCATAGGCTCCGCC

CCCCTGACGAGCATCACAAAAATCGACGCTCAAGTCAGAGGTGGCGAAAC

CCGACAGGACTATAAAGATACCAGGCGTTTCCCCCTGGAAGCTCCCTCGT

GCGCTCTCCTGTTCCGACCCTGCCGCTTACCGGATACCTGTCCGCCTTTC

TCCCTTCGGGAAGCGTGGCGCTTTCTCATAGCTCACGCTGTAGGTATCTC

AGTTCGGTGTAGGTCGTTCGCTCCAAGCTGGGCTGTGTCCACGAACCCCC

CGTTCAGCCCGACCGCTGCGCCTTATCCGGTAACTATCGTCTTGAGTCCA

ACCCGGTAAGACACGACTTATCGCCACTGGCAGCAGCCACTGGTAACAGG

ATTAGCAGAGCGAGGTATGTAGGCGGTGCTACAGAGTTCTTGAAGTGGTG

GCCTAACTACGGCTACACTAGAAGAACAGTATTTGGTATCTGCGCTCTGC

TGAAGCCAGTTACCTTCGGAAAAAGAGTTGGTAGCTCTTGATCCGGCAAA

CAAACCACCGCTGGTAGCGGTGGTTTTTTTGTTTGCAAGCAGCAGATTAC

GCGCAGAAAAAAAGGATCTCAAGAAGATCCTTTGATCTTTTCTACGGGGT

CTGACGCTCAGTGGAACGAAAACTCACGTTAAGGGATTTTGGTCATGAGA

TTATCAAAAAGGATCTTCACCTAGATCCTTTTAAATTAAAAATGAAGTTT

TAAATCAATCTAAAGTATATATGAGTAAACTTGGTCTGACAGTTACCAAT

GCTTAATCAGTGAGGCACCTATCTCAGCGATCTGTCTATTTCGTTCATCC

ATAGTTGCCTGACTCCCCGTCGTGTAGATAACTACGATACGGGAGGGCTT

ACCATCTGGCCCCAGTGCTGCAATGATACCGCGAGACCCACGCTCACCGG

CTCCAGATTTATCAGCAATAAACCAGCCAGCCGGAAGGGCCGAGCGCAGA

AGTGGTCCTGCAACTTTATCCGCCTCCATCCAGTCTATTAATTGTTGCCG

GGAAGCTAGAGTAAGTAGTTCGCCAGTTAATAGTTTGCGCAACGTTGTTG

CCATTGCTACAGGCATCGTGGTGTCACGCTCGTCGTTTGGTATGGCTTCA

TTCAGCTCCGGTTCCCAACGATCAAGGCGAGTTACATGATCCCCCATGTT

GTGCAAAAAAGCGGTTAGCTCCTTCGGTCCTCCGATCGTTGTCAGAAGTA

AGTTGGCCGCAGTGTTATCACTCATGGTTATGGCAGCACTGCATAATTCT

CTTACTGTCATGCCATCCGTAAGATGCTTTTCTGTGACTGGTGAGTACTC

AACCAAGTCATTCTGAGAATAGTGTATGCGGCGACCGAGTTGCTCTTGCC

CGGCGTCAATACGGGATAATACCGCGCCACATAGCAGAACTTTAAAAGTG

CTCATCATTGGAAAACGTTCTTCGGGGCGAAAACTCTCAAGGATCTTACC

GCTGTTGAGATCCAGTTCGATGTAACCCACTCGTGCACCCAACTGATCTT

CAGCATCTTTTACTTTCACCAGCGTTTCTGGGIGAGCAAAAACAGGAAGG

CAAAATGCCGCAAAAAAGGGAATAAGGGCGACACGGAAATGTTGAATACT

CATACTCTTCCTTTTTCAATATTATTGAAGCATTTATCAGGGTTATTGTC

TCATGAGCGGATACATATTTGAATGTATTTAGAAAAATAAACAAATAGGG

GTTCCGCGCACATTTCCCCGAAAAGTGCCACCTGACGTCTAAGAAACCAT

TATTATCATGACATTAACCTATAAAAATAGGCGTATCACGAGGCCCTTTC

GTC
```

Figure 2:
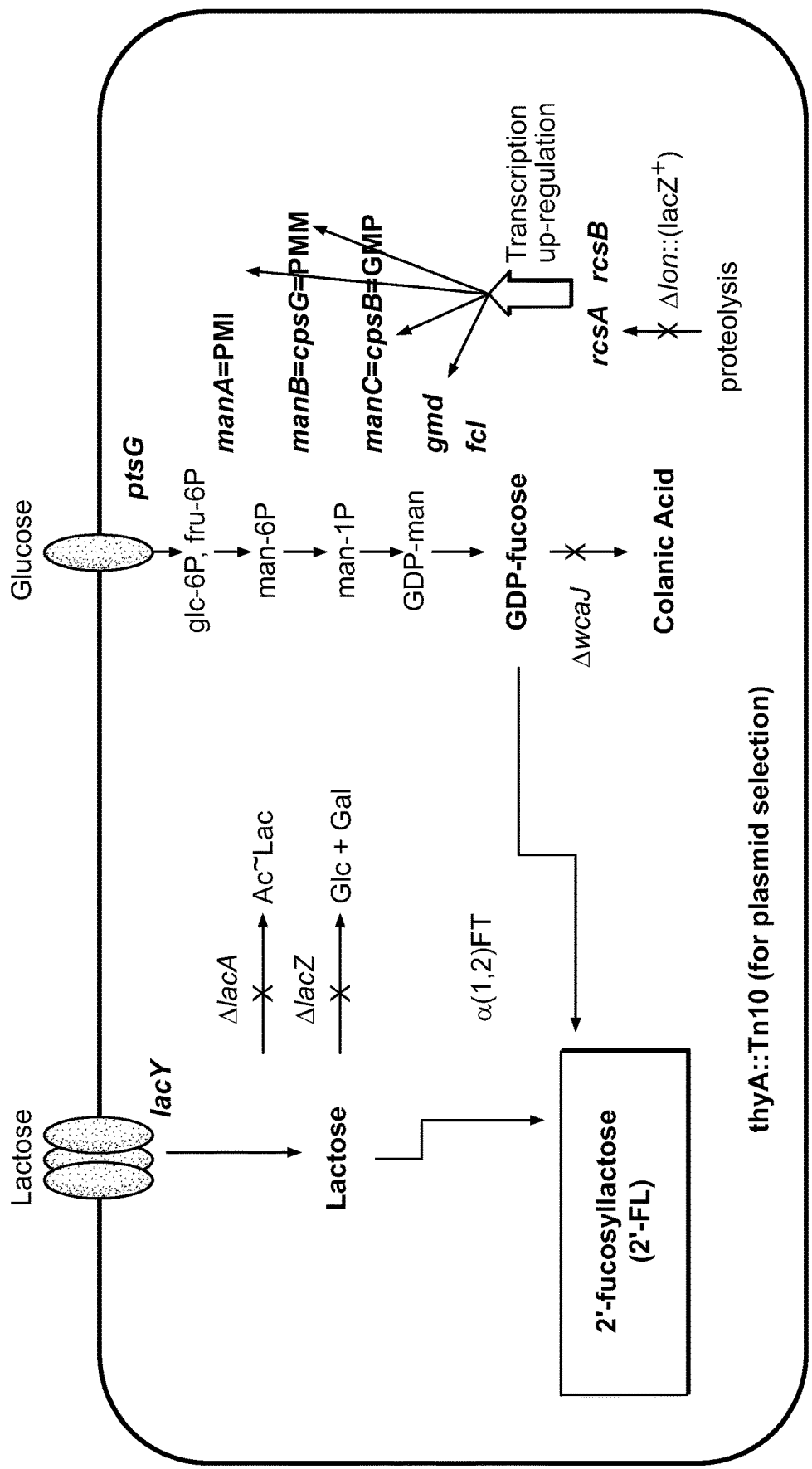
FIG. 2 is a schematic demonstrating metabolic pathways and the changes introduced into them to engineer 2'-fucosyllactose (2'-FL) synthesis in *Escherichia coli* (*E. coli*). Specifically, the lactose synthesis pathway and the GDP-fucose synthesis pathway are illustrated. In the GDP-fucose synthesis pathway: manA=phosphomannose isomerase (PMI), manB=phosphomannomutase (PMM), manC=mannose-1-phosphate guanylyltransferase (GMP), gmd=GDP-mannose-4,6-dehydratase, fcl=GDP-fucose synthase (GFS), and ΔwcaJ=mutated UDP-glucose lipid carrier transferase.

The expression constructs were transformed into a host strain useful for the production of 2'-FL. Biosynthesis of 2'-FL requires the generation of an enhanced cellular pool of both lactose and GDP-fucose (FIG. 2). The wild-type Eschericia coli K12 prototrophic strain W3110 was selected as the parent background to test the ability of the candidates to catalyze 2'-FL production (Bachmann, B. J. (1972). Bacteriol Rev 36, 525-557). The particular W3110 derivative employed was one that previously had been modified by the introduction (at the ampC locus) of a tryptophan-inducible $P_{trp}B$ cI+ repressor cassette, generating an *E. coli* strain known as GI724 (LaVallie, E. R. et al. (2000). Methods Enzymol 326, 322-340). Other features of GI724 include lacIq and lacPL8 promoter mutations. *E. coli* strain GI724 affords economical production of recombinant proteins from the phage λ $P_L$ promoter following induction with low levels of exogenous tryptophan (LaVallie, E. R. et al. (1993). Biotechnology (N Y) 11, 187-193; Mieschendahl, et al. (1986). Bio/Technology 4, 802-08). Additional genetic alterations were made to this strain to promote the biosynthesis of 2'-FL. This was achieved in strain GI724 through several manipulations of the chromosome using λ Red recombineering (Court, D. L. et al. (2002). Annu Rev Genet 36, 361-388) and generalized P1 phage transduction.

First, the ability of the *E. coli* host strain to accumulate intracellular lactose was engineered by simultaneous deletion of the endogenous β-galactosidase gene (lacZ) and the lactose operon repressor gene (laI). During construction of this deletion, the lacIq promoter was placed immediately upstream of the lactose permease gene, lacY. The modified strain maintains its ability to transport lactose from the culture medium (via LacY), but is deleted for the wild-type copy of the lacZ (β-galactosidase) gene responsible for lactose catabolism. Therefore, an intracellular lactose pool is created when the modified strain is cultured in the presence of exogenous lactose. A schematic of the $P_{lacIq}$ lacY$^+$ chromosomal construct is shown in FIG. 12.

Genomic DNA sequence of the $P_{lacIq}$ lacY$^+$ chromosomal construct is set forth below (SEQ ID NO: 288):

CACCATCGAATGGCGCAAAACCTTTCGCGGTATGGCATGATAGCGCCCG

GAAGAGAGTCAAGTGTAGGCTGGAGCTGCTTCGAAGTTCCTATACTTTC

TAGAGAATAGGAACTTCGGAATAGGAACTTCGGAATAGGAACTAAGGAG

GATATTCATATGTACTATTTAAAAAACACAAACTTTTGGATGTTCGGTT

TATTCTTTTTCTTTTACTTTTTTATCATGGGAGCCTACTTCCCGTTTTT

CCCGATTTGGCTACATGACATCAACCATATCAGCAAAAGTGATACGGGT

ATTATTTTTGCCGCTATTTCTCTGTTCTCGCTATTATTCCAACCGCTGT

TTGGTCTGCTTTCTGACAAACTCGGGCTGCGCAAATACCTGCTGTGGAT

TATTACCGGCATGTTAGTGATGTTTGCGCCGTTCTTTATTTTTATCTTC

GGGCCACTGTTACAATACAACATTTTAGTAGGATCGATTGTTGGTGGTA

TTTATCTAGGCTTTTGTTTTAACGCCGGTGCGCCAGCAGTAGAGGCATT

TATTGAGAAAGTCAGCCGTCGCAGTAATTTCGAATTTGGTCGCGCGCGG

ATGTTTGGCTGTGTTGGCTGGGCGCTGTGTGCCTCGATTGTCGGCATCA

TGTTCACCATCAATAATCAGTTTGTTTTCTGGCTGGGCTCTGGCTGTGC

ACTCATCCTCGCCGTTTTACTCTTTTTCGCCAAAACGGATGCGCCCTCT

TCTGCCACGGTTGCCAATGCGGTAGGTGCCAACCATTCGGCATTTAGCC

TTAAGCTGGCACTGGAACTGTTCAGACAGCCAAAACTGTGGTTTTTGTC

ACTGTATGTTATTGGCGTTTCCTGCACCTACGATGTTTTTGACCAACAG

TTTGCTAATTTCTTTTACTTCGTTCTTTGCTACCGGTGAACAGGGTACGC

GGGTATTTGGCTACGTAACGACAATGGGCGAATTACTTAACGCCTCGAT

TATGTTCTTTGCGCCACTGATCATTAATCGCATCGGTGGGAAAAACGCC

CTGCTGCTGGCTGGCACTATTATGTCTGTACGTATTATTGGCTCATCGT

TCGCCACCTCAGCGCTGGAAGTGGTTATTCTGAAAACGCTGCATATGTT

TGAAGTACCGTTCCTGCTGGTGGGCTGCTTTAAATATATTACCAGCCAG

TTTGAAGTGCGTTTTTCAGCGACGATTTATCTGGTCTGTTTCTGCTTCT

TTAAGCAACTGGCGATGATTTTTATGTCTGTACTGGCGGGCAATATGTA

TGAAAGCATCGGTTTCCAGGGCGCTTATCTGGTGCTGGGTCTGGTGGCG

CTGGGCTTCACCTTAATTTCCGTGTTCACGCTTAGCGGCCCCGGCCCGC

TTTCCCTGCTGCGTCGTCAGGTGAATGAAGTCGCTTAAGCAATCAATGT

CGGATGCGGCGCGAGCGCCTTATCCGACCAACATATCATAACGGAGTGA

TCGCATTGTAAATTATAAAAATTGCCTGATACGCTGCGCTTATCAGGCC

TACAAGTTCAGCGATCTACATTAGCCGCATCCGGCATGAACAAAGCGCA

GGAACAAGCGTCGCA

Second, the ability of the host *E. coli* strain to synthesize colanic acid, an extracellular capsular polysaccharide, was eliminated by the deletion of the wcaJ gene, encoding the UDP-glucose lipid carrier transferase (Stevenson, G. et al. (1996). J Bacteriol 178, 4885-893). In a wcaJ null background GDP-fucose accumulates in the *E. coli* cytoplasm (Dumon, C. et al. (2001). Glycoconj J 18, 465-474). A schematic of the chromosomal deletion of wcaJ is shown in FIG. 13.

The sequence of the chromosomal region of *E. coli* bearing the ΔwcaJ::FRT mutation is set forth below (SEQ ID NO: 289):

GTTCGGTTATATCAATGTCAAAAACCTCACGCCGCTCAAGCTGGTGATCA

ACTCCGGGAACGGCGCAGCGGGTCCGGTGGTGGACGCCATTGAAGCCCGC

TTTAAAGCCCTCGGCGCGCCCGTGGAATTAATCAAAGTGCACAACACGCC

GGACGGCAATTTCCCCAACGGTATTCCTAACCCACTACTGCCGGAATGCC

GCGACGACACCCGCAATGCGGTCATCAAACACGGCGCGGATATGGGCATT

GCTTTTGATGGCGATTTTGACCGCTGTTTCCTGTTTGACGAAAAAGGGCA

GTTTATTGAGGGCTACTACATTGTCGGCCTGTTGGCAGAAGCATTCCTCG

AAAAAAATCCCGGCGCGAAGATCATCCACGATCCACGTCTCTCCTGGAAC

ACCGTTGATGTGGTGACTGCCGCAGGTGGCACGCCGGTAATGTCGAAAAC

CGGACACGCCTTTATTAAAGAACGTATGCGCAAGGAAGACGCCATCTATG

GTGGCGAAATGAGCGCCCACCATTACTTCCGTGATTTCGCTTACTGCGAC

AGCGGCATGATCCCGTGGCTGCTGGTCGCCGAACTGGTGTGCCTGAAAGA

TAAAACGCTGGGCGAACTGGTACGCGACCGGATGGCGGCGTTTCCGGCAA

GCGGTGAGATCAACAGCAAACTGGCGCAACCCGTTGAGGCGATTAACCGC

GTGGAACAGCATTTTAGCCGTGAGGCGCTGGCGGTGGATCGCACCGATGG

CATCAGCATGACCTTTGCCGACTGGCGCTTTAACCTGCGCACCTCCAATA

CCGAACCGGTGGTGCGCCTGAATGTGGAATCGCGCGGTGATGTGCCGCTG

```
ATGGAAGCGCGAACGCGAACTCTGCTGACGTTGCTGAACGAGTAATGTCG
GATCTTCCCTTACCCCACTGCGGGTAAGGGGCTAATAACAGGAACAACGA
TGATTCCGGGGATCCGTCGACCTGCAGTTCGAAGTTCCTATTCTCTAGAA
AGTATAGGAACTTCGAAGCAGCTCCAGCCTACAGTTAACAAAGCGGCATA
TTGATATGAGCTTACGTGAAAAAACCATCAGCGGCGCGAAGTGGTCGGCG
ATTGCCACGGTGATCATCATCGGCCTCGGGCTGGTGCAGATGACCGTGCT
GGCGCGGATTATCGACAACCACCAGTTCGGCCTGCTTACCGTGTCGCTGG
TGATTATCGCGCTGGCAGATACGCTTTCTGACTTCGGTATCGCTAACTCG
ATTATTCAGCGAAAAGAAATCAGTCACCTTGAACTCACCACGTTGTACTG
GCTGAACGTCGGGCTGGGGATCGTGGTGTGCGTGGCGGTGTTTTTGTTGA
GTGATCTCATCGGCGACGTGCTGAATAACCCGGACCTGGCACCGTTGATT
AAACATTATCGCTGGCGTTTGTGGTAATCCCCCACGGGCAACAGTTCCG
CGCGTTGATGCAAAAAGAGCTGGAGTTCAACAAAATCGGCATGATCGAAA
CCAGCGCGGTGCTGGCGGGCTTCACTTGTACGGTGGTTAGCGCCCATTTC
TGGCCGCTGGCGATGACCGCGATCCTCGGTTATCTGGTCAATAGTGCGGT
GAGAACGCTGCTGTTTGGCTACTTTGGCCGCAAAATTTATCGCCCCGGTC
TGCATTTCTCGCTGGCGTCGGTGGCACCGAACTTACGCTTTGGTGCCTGG
CTGACGGCGGACAGCATCATCAACTATCTCAATACCAACCTTTCAACGCT
CGTGCTGGCGCGTATTCTCGGCGCGGGCGTGGCAGGGGGATACAACCTGG
CGTACAACGTGGCCGTTGTGCCACCGATGAAGCTGAACCCAATCATCACC
CGCGTGTTGTTTCCGGCATTCGCCAAAATTCAGGACGATACCGAAAAGCT
GCGTGTTAACTTCTACAAGCTGCTGTCGGTAGTGGGGATTATCAACTTTC
CGGCGCTGCTCGGGCTAATGGTGGTGTCGAATAACTTTGTACCGCTGGTC
TTTGGTGAGAAGTGGAACAGCATTATTCCGGTGCTGCAATTGCTGTGTGT
GGTGGGTCTGCTGCGCTCCG
```

Third, the magnitude of the cytoplasmic GDP-fucose pool was enhanced by the introduction of a null mutation into the lon gene. Lon is an ATP-dependant intracellular protease that is responsible for degrading RcsA, which is a positive transcriptional regulator of colanic acid biosynthesis in *E. coli* (Gottesman, S. & Stout, V. Mol Microbiol 5, 1599-1606 (1991)). In a lon null background, RcsA is stabilized, RcsA levels increase, the genes responsible for GDP-fucose synthesis in *E. coli* are up-regulated, and intracellular GDP-fucose concentrations are enhanced. The lon gene was almost entirely deleted and replaced by an inserted functional, wild-type, but promoter-less *E. coli* lacZ$^+$ gene (Δlon::(kan, lacZ$^+$). λ Red recombineering was used to perform the construction. A schematic of the kan, lacZ$^+$ insertion into the lon locus is shown in FIG. 14.

Genomic DNA sequence surrounding the lacZ+ insertion into the lon region in the *E. coli* strain is set forth below (SEQ ID NO: 290):

```
GTGGATGGAAGAGGTGGAAAAAGTGGTTATGGAGGAGTGGGTAATTGATG
GTGAAAGGAAAGGGTTGGTGATTTATGGGAAGGGGAAGGGGAAGAGGGA
TGTGGTGAATAATTAAGGATTGGGATAGAATTAGTTAAGGAAAAAGGGGG
GATTTTATGTGGGGTTTAATTTTTGGTGTATTGTGGGGGTTGAATGTGGG
GGAAAGATGGGGATATAGTGAGGTAGATGTTAATAGATGGGGTGAAGGAG
AGTGGTGTGATGTGATTAGGTGGGGGAAATTAAAGTAAGAGAGAGGTGTA
TGATTGGGGGATGGGTGGAGGTGGAGTTGGAAGTTGGTATTGTGTAGAA
AGTATAGGAAGTTGAGAGGGGTTTTGAAGGTGAGGGTGGGGAAGGAGTG
AGGGGGGAAGGGGTGGTAAAGGAAGGGGAAGAGGTAGAAAGGGAGTGGGG
AGAAAGGGTGGTGAGGGGGGATGAATGTGAGGTAGTGGGGTATGTGGAGA
AGGGAAAAGGGAAGGGGAAAGAGAAAGGAGGTAGGTTGGAGTGGGGTTAG
ATGGGGATAGGTAGAGTGGGGGGTTTTATGGAGAGGAAGGGAAGGGGAAT
TGGGAGGTGGGGGGGGGGTGTGGTAAGGTTGGGAAGGGGTGGAAAGTAAAG
TGGATGGGTTTGTTGGGGGGAAGGATGTGATGGGGGAGGGGATGAAGATG
TGATGAAGAGAGAGGATGAGGATGGTTTGGGATGATTGAAGAAGATGGAT
TGGAGGGAGGTTGTGGGGGGGGTTGGGTGGAGAGGGTATTGGGGTATGAG
TGGGGAGAAGAGAGAATGGGGTGGTGTGATGGGGGGGTGTTGGGGGTGTG
AGGGGAGGGGGGGGGGGTTGTTTTTGTGAAGAGGGAGGTGTGGGGTGGGG
TGAATGAAGTGGAGGAGGAGGGAGGGGGGTATGGTGGGTGGGAGGAGG
GGGGTTGGTTGGGGAGGTGTGGTGGAGGTTGTGAGTGAAGGGGGAAGGGA
GTGGGTGGTATTGGGGAAGTGGGGGGGGAGGATGTGGTGTGATGTGAGG
TTGGTGGTGGGGAGAAAGTATGGATGATGGGTGATGGAATGGGGGGGGTG
GATAGGGTTGATGGGGTAGGTGGGGATTGGAGGAGGAAGGGAAAGATGG
GATGGAGGGAGGAGGTAGTGGGATGGAAGGGGGTGTTGTGGATGAGGATG
ATGTGGAGGAAGAGGATGAGGGGGTGGGGGGAGGGGAAGTGTTGGGGAGG
GTGAAGGGGGATGGGGGAGGGGGAGGATGTGGTGGTGAGGGATGGGGAT
GGGTGGTTGGGGAATATGATGGTGGAAAATGGGGGTTTTGTGGATTGAT
GGAGTGTGGGGGGGTGGGTGTGGGGGAGGGGTATGAGGAGATAGGGTTGG
GTAGGGGTGATATTGGTGAAGAGGTTGGGGGGGAATGGGGTGAGGGGTTG
GTGGTGGTTTAGGGTATGGGGGGTGGGGATTGGGAGGGGATGGGGTTGTA
TGGGGTTGTTGAGGAGTTGTTGTAATAAGGGGATGTTGAAGTTGGTATTG
GGAAGTTGGTATTGTGTAGAAAGTATAGGAAGTTGGAAGGAGGTGGAGGG
TAGATAAAGGGGGGGGTTATTTTTGAGAGGAGAGGAAGTGGTAATGGTAG
GGAGGGGGGTGAGGTGGAATTGGGGGGATAGTGAGGGGGTGGAGGAGTG
GTGGGGAGGAATGGGGATATGGAAAGGGTGGATATTGAGGGATGTGGGTT
GTTGGGGGTGGAGGAGATGGGGATGGGTGGTTTGGATGAGTTGGTGTTGA
GTGTAGGGGGTGATGTTGAAGTGGAAGTGGGGGGGGGAGTGGTGTGGGGG
ATAATTGAATTGGGGGTGGGGAGGGGAGAGGGTTTGGGTGGGGAAGA
GGTAGGGGGTATAGATGTTGAGAATGGGAGATGGGAGGGGTGAAAAGAGG
GGGGAGTAAGGGGGTGGGGATAGTTTTGTTGGGGGGGTAATGGGAGGGAG
TTTAGGGGGTGTGGTAGGTGGGGGAGGTGGGAGTTGAGGGGAATGGGGGG
GGGATGGGGTGTATGGGTGGGGAGTTGAAGATGAAGGGTAATGGGGATTT
GAGGAGTAGGATGAATGGGGTAGGTTTTGGGGGTGATAAATAAGGTTTTG
GGGTGATGGTGGGAGGGGTGAGGGGTGGTAATGAGGAGGGGATGAGGAAG
```

-continued

```
TGTATGTGGGGTGGAGTGGAAGAAGGGTGGTTGGGGGTGGTAATGGGGGG
GGGGGTTGGAGGGTTGGAGGGAGGGGTTAGGGTGAATGGGGGTGGGTTGA
GTTAGGGGAATGTGGTTATGGAGGGGTGGAGGGGTGAAGTGATGGGGGAG
GGGGGTGAGGAGTTGTTTTTTATGGGGAATGGAGATGTGTGAAAGAAAGG
GTGAGTGGGGGTTAAATTGGGAAGGGTTATTAGGGAGGTGGATGGAAAAA
TGGATTTGGGTGGTGGTGAGATGGGGATGGGTGGGAGGGGGGGGGAG
GGTGAGAGTGAGGTTTTGGGGGAGAGGGGAGTGGTGGGAGGGGGTGATGT
GGGGGGGTTGTGAGGATGGGGTGGGGTTGGGTTGGAGTAGGGGTAGTGTG
AGGGAGAGTTGGGGGGGGGTGTGGGGGTGGGGTAGTTGAGGGAGTTGAAT
GAAGTGTTTAGGTTGTGGAGGGAGATGGAGAGGGAGTTGAGGGGTTGGGA
GGGGGTTAGGATGGAGGGGGAGGATGGAGTGGAGGAGGTGGTTATGGGTA
TGAGGGAAGAGGTATTGGGTGGTGAGTTGGATGGTTTGGGGGGATAAAGG
GAAGTGGAAAAAGTGGTGGTGGTGTTTTGGTTGGGTGAGGGGTGGATGGG
GGGTGGGGTGGGGAAAGAGGAGAGGGTTGATAGAGAAGTGGGGATGGTTG
GGGGTATGGGGAAAATGAGGGGGGTAAGGGGAGGAGGGGTTGGGGTTTTG
ATGATATTTAATGAGGGAGTGATGGAGGGAGTGGGAGAGGAAGGGGGGGT
GTAAAGGGGGATAGTGAGGAAAGGGGTGGGAGTATTTAGGGAAAGGGGGA
AGAGTGTTAGGGATGGGGTGGGGGTATTGGGAAAGGATGAGGGGGGGGGT
GTGTGGAGGTAGGGAAAGGGATTTTTTGATGGAGGATTTGGGGAGAGGGG
GGAAGGGGTGGTGTTGATGGAGGGGGGGGTAGATGGGGGAAATAATATGG
GTGGGGGTGGTGTGGGGTGGGGGGGGTTGATAGTGGAGGGGGGGGAAGG
ATGGAGAGATTTGATGGAGGGATAGAGGGGGTGGTGATTAGGGGGGTGGG
GTGATTGATTGGGGAGGGAGGAGATGATGAGAGTGGGGTGATTAGGATGG
GGGTGGAGGATTGGGGTTAGGGGTTGGGTGATGGGGGTAGGGAGGGGGG
ATGATGGGTGAGAGGATTGATTGGGAGGATGGGGTGGGTTTGAATATTGG
GTTGATGGAGGAGATAGAGGGGGTAGGGGTGGGAGAGGGTGTAGGAGAGG
GGATGGTTGGGATAATGGGAAGAGGGGAGGGGGTTAAAGTTGTTGTGGTT
GATGAGGAGGATATGGTGGAGGATGGTGTGGTGATGGATGAGGTGAGGAT
GGAGAGGATGATGGTGGTGAGGGTTAAGGGGTGGAATGAGGAAGGGGTTG
GGGTTGAGGAGGAGGAGGATTTTGAATGGGGAGGTGGGGGAAAGGGAG
ATGGGAGGGTTGTGGTTGAATGAGGGTGGGGTGGGGGTGTGGAGTTGAA
GGAGGGGAGGATAGAGATTGGGGATTTGGGGGGTGGAGAGTTTGGGGTTT
TGGAGGTTGAGAGGTAGTGTGAGGGGATGGGGATAAGGAGGAGGGTGATG
GATAATTTGAGGGGGGAAAGGGGGGTGGGGTGGGAGGTGGGTTTGAG
GGTGGGATAAAGAAAGTGTTAGGGGTAGGTAGTGAGGGAAGTGGGGGAG
ATGTGAAGTTGAGGGTGGAGTAGAGGGGGGTGAAATGATGATTAAAGGG
AGTGGGAAGATGGAAATGGGTGATTTGTGTAGTGGGTTTATGGAGGAAGG
AGAGGTGAGGGAAAATGGGGGTGATGGGGAGATATGGTGATGTTGGAGA
TAAGTGGGGTGAGTGGAGGGGAGGAGGATGAGGGGGAGGGGTTTTGTGG
GGGGGGTAAAAATGGGGTGAGGTGAAATTGAGAGGGGAAAGGAGTGTGGT
GGGGGTAAGGGAGGGAGGGGGGGTTGGAGGAGAGATGAAAGGGGGAGTTA
AGGGGATGAAAAATAATTGGGGTGTGGGGTTGGTGTAGGGAGGTTTGATG
AAGATTAAATGTGAGGGAGTAAGAAGGGGTGGGATTGTGGGTGGGAAGAA
AGGGGGGATTGAGGGTAATGGGATAGGTGAGGTTGGTGTAGATGGGGGA
TGGTAAGGGTGGATGTGGGAGTTTGAGGGGAGGAGGAGAGTATGGGGGTG
AGGAAGATGGGAGGGAGGGAGGTTTGGGGGAGGGGTTGTGGTGGGGGAAA
GGAGGGAAAGGGGGATTGGGGATTGAGGGTGGGGAAGTGTTGGGAAGGGG
GATGGGTGGGGGGGTGTTGGGTATTAGGGGAGGTGGGGAAAGGGGGATGT
GGTGGAAGGGGATTAAGTTGGGTAAGGGGAGGGTTTTGGGAGTGAGGAGG
TTGTAAAAGGAGGGGAGTGAATGGGTAATGATGGTGATAGTAGGTTTGG
TGAGGTTGTGAGTGGAAAATAGTGAGGTGGGGGAAAATGGAGTAATAAAA
AGAGGGGTGGGAGGGTAATTGGGGGTTGGGAGGGTTTTTTTGTGTGGGTA
AGTTAGATGGGGATGGGGGTTGGGGTTATTAAGGGGTGTTGTAAGGGGA
TGGGTGGGGTGATATAAGTGGTGGGGGTTGGTAGGTTGAAGGATTGAAGT
GGGATATAAATTATAAAGAGGAAGAGAAGAGTGAATAAATGTGAATTGAT
GGAGAAGATTGGTGGAGGGGTGATATGTGTAAAGGTGGGGGTGGGGGTG
GGTTAGATGGTATTATTGGTTGGGTAAGTGAATGTGTGAAAGAAGG
```

Fourth, a thyA (thymidylate synthase) mutation was introduced into the strain by P1 transduction. In the absence of exogenous thymidine, thyA strains are unable to make DNA and die. The defect can be complemented in trans by supplying a wild-type thyA gene on a multicopy plasmid (Belfort, M., Maley, G. F., and Maley, F. (1983). Proc Natl Acad Sci USA 80, 1858-861). This complementation was used here as a means of plasmid maintenance.

An additional modification that is useful for increasing the cytoplasmic pool of free lactose (and hence the final yield of 2'-FL) is the incorporation of a lacA mutation. LacA is a lactose acetyltransferase that is only active when high levels of lactose accumulate in the E. coli cytoplasm. High intracellular osmolarity (e.g., caused by a high intracellular lactose pool) can inhibit bacterial growth, and E. coli has evolved a mechanism for protecting itself from high intra cellular osmlarity caused by lactose by "tagging" excess intracellular lactose with an acetyl group using LacA, and then actively expelling the acetyl-lactose from the cell (Danchin, A. Bioessays 31, 769-773 (2009)). Production of acetyl-lactose in E. coli engineered to produce 2'-FL or other human milk oligosaccharides is therefore undesirable: it reduces overall yield. Moreover, acetyl-lactose is a side product that complicates oligosaccharide purification schemes. The incorporation of a lacA mutation resolves these problems. Sub-optimal production of fucosylated oligosaccharides occurs in strains lacking either or both of the mutations in the colanic acid pathway and the lon protease. Diversion of lactose into a side product (acetyl-lactose) occurs in strains that do not contain the lacA mutation. A schematic of the lacA deletion and corresponding genomic sequence is provided above (SEQ ID NO: 288).

The strain used to test the different α(1,2) FT candidates incorporates all the above genetic modifications and has the following genotype:

ΔampC::$P_{trp}^{B}$cI, Δ(lacI-lacZ)::FRT, $P_{lacIq}$lacY$^+$, ΔwcaJ::FRT, thyA::Tn10, Δlon:(npt3, lacZ$^+$), ΔlacA The E. coli strains harboring the different α(1,2) FT candidate expression plasmids were analyzed. Strains were grown in selective media (lacking thymidine) to early exponential phase. Lactose was then added to a final concentration of 0.5%, and tryptophan (200 µM) was added to induce expression of each candidate α(1,2) FT from the P_L promoter. At the end of the induction period (~24 h) equivalent OD 600 units of each strain and the culture supernatant was harvested. Lysates were prepared and analyzed for the presence of 2'-FL by thin layer chromatography (TLC).

Figure 11:
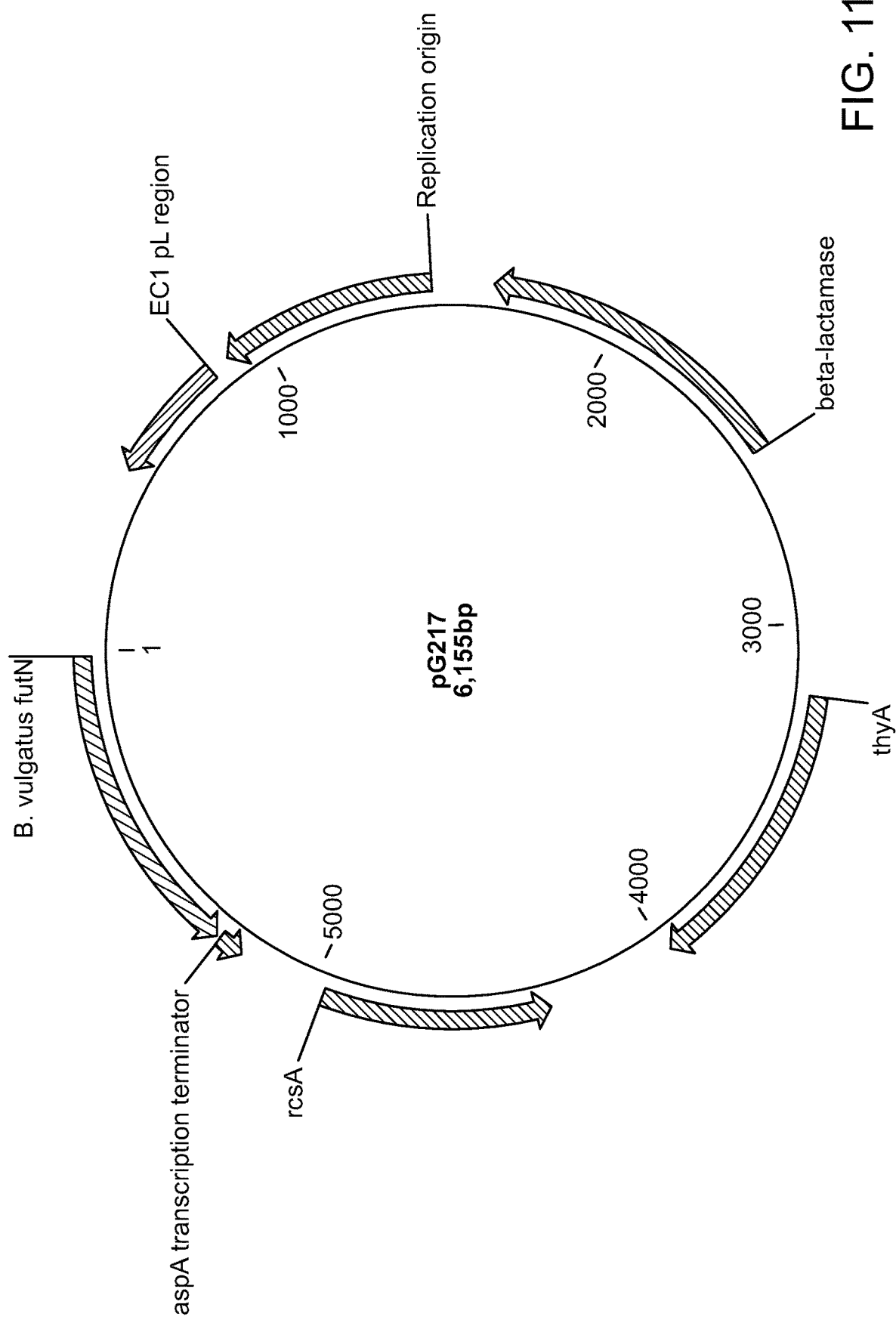
FIG. 11 is a plasmid map of pG217 carrying the *B. vulgatus* FutN gene.

A map of plasmid pG217 is shown in FIG. 11, which carries the *B. vulgatus* FutN. The sequence of plasmid pG217 is set forth below (SEQ ID NO: 291):

```
TCTAGAATTCTAAAAATTGATTGAATGTATGCAAATAAATGCATACA

CCATAGGTGTGGTTTAATTTGATGCCCTTTTTCAGGGCTGGAATGTG

TAAGAGCGGGGTTATTTATGCTGTTGTTTTTTGTTACTCGGGAAGG

GCTTTACCTCTTCCGCATAAACGCTTCCATCAGCGTTTATAGTTAAA

AAAATCTTTCGGAACTGGTTTTGCGCTTACCCCAACCAACAGGGGAT

TTGCTGCTTTCCATTGAGCCTGTTTCTCTGCGCGACGTTCGCGGCGG

CGTGTTTGTGCATCCATCTGGATTCTCCTGTCAGTTAGCTTTGGTGG

TGTGTGGCAGTTGTAGTCCTGAACGAAAACCCCCCGCGATTGGCACA

TTGGCAGCTAATCCGGAATCGCACTTACGGCCAATGCTTCGTTTCGT

ATCACACACCCCAAAGCCTTCTGCTTTGAATGCTGCCCTTCTTCAGG

GCTTAATTTTTAAGAGCGTCACCTTCATGGTGGTCAGTGCGTCCTGC

TGATGTGCTCAGTATCACCGCCAGTGGTATTTATGTCAACACCGCCA

GAGATAATTTATCACCGCAGATGGTTATCTGTATGTTTTTTATATGA

ATTTATTTTTTGCAGGGGGGCATTGTTTGGTAGGTGAGAGATCAATT

CTGCATTAATGAATCGGCCAACGCGCGGGGAGAGGCGGTTTGCGTAT

TGGGCGCTCTTCCGCTTCCTCGCTCACTGACTCGCTGCGCTCGGTCG

TTCGGCTGCGGCGAGCGGTATCAGCTCACTCAAAGGCGGTAATACGG

TTATCCACAGAATCAGGGGATAACGCAGGAAAGAACATGTGAGCAAA

AGGCCAGCAAAAGGCCAGGAACCGTAAAAAGGCCGCGTTGCTGGCGT

TTTTCCATAGGCTCCGCCCCCCTGACGAGCATCACAAAAATCGACGC

TCAAGTCAGAGGTGGCGAAACCCGACAGGACTATAAAGATACCAGGC

GTTTCCCCCTGGAAGCTCCCTCGTGCGCTCTCCTGTTCCGACCCTGC

CGCTTACCGGATACCTGTCCGCCTTTCTCCCTTCGGGAAGCGTGGCG

CTTTCTCATAGCTCACGCTGTAGGTATCTCAGTTCGGTGTAGGTCGT

TCGCTCCAAGCTGGGCTGTGTGCACGAACCCCCCGTTCAGCCCGACC

GCTGCGCCTTATCCGGTAACTATCGTCTTGAGTCCAACCCGGTAAGA

CACGACTTATCGCCACTGGCAGCAGCCACTGGTAACAGGATTAGCAG

AGCGAGGTATGTAGGCGGTGCTACAGAGTTCTTGAAGTGGTGGCCTA

ACTACGGCTACACTAGAAGGACAGTATTTGGTATCTGCGCTCTGCTG

AAGCCAGTTACCTTCGGAAAAAGAGTTGGTAGCTCTTGATCCGGCAA

ACAAACCACCGCTGGTAGCGGTGGTTTTTTTGTTTGCAAGCAGCAGA

TTACGCGCAGAAAAAAAGGATCTCAAGAAGATCCTTTGATCTTTTCT

ACGGGGTCTGACGCTCAGTGGAACGAAAACTCACGTTAAGGGATTTT

GGTCATGAGATTATCAAAAAGGATCTTCACCTAGATCCTTTTAAATT

AAAAATGAAGTTTTAAATCAATCTAAAGTATATATGAGTAAACTTGG

TGTGACAGTTACCAATGCTTAATCAGTGAGGCACCTATCTCAGCGAT

CTGTCTATTTCGTTCATCCATAGTTGCCTGACTCCCCGTCGTGTAGA

TAACTACGATACGGGAGGGCTTACCATCTGGCCCCAGTGCTGCAATG

ATACCGCGAGACCCACGCTCACCGGCTCCAGATTTATCAGCAATAAA

CCAGCCAGCCGGAAGGGCCGAGCGCAGAAGTGGTCCTGCAACTTTAT

CCGCCTCCATCCAGTCTATTAATTGTTGCCGGGAAGCTAGAGTAAGT

AGTTCGCCAGTTAATAGTTTGCGCAACGTTGTTGCCATTGCTACAGG

CATCGTGGTGTCACGCTCGTCGTTTGGTATGGCTTCATTCAGCTCCG

GTTCCCAACGATCAAGGCGAGTTACATGATCCCCCATGTTGTGCAAA

AAAGCGGTTAGCTCCTTCGGTCCTCCGATCGTTGTCAGAAGTAAGTT

GGCCGCAGTGTTATCACTCATGGTTATGGCAGCACTGCATAATTCTC

TTACTGTCATGCCATCCGTAAGATGCTTTTCTGTGACTGGTGAGTAC

TCAACCAAGTCATTCTGAGAATAGTGTATGCGGCGACCGAGTTGCTC

TTGCCCGGCGTCAATACGGGATAATACCGCGCCACATAGCAGAACTT

TAAAAGTGCTCATCATTGGAAAACGTTCTTCGGGGCGAAAACTCTCA

AGGATCTTACCGCTGTTGAGATCCAGTTCGATGTAACCCACTCGTGC

ACCCAACTGATCTTCAGCATCTTTTACTTTCACCAGCGTTTCTGGGT

GAGCAAAAACAGGAAGGCAAAATGCCGCAAAAAAGGGAATAAGGGCG

ACACGGAAATGTTGAATACTCATACTCTTCCTTTTTCAATATTATTG

AAGCATTTATCAGGGTTATTGTCTCATGAGCGGATACATATTTGAAT

GTATTTAGAAAAATAAACAAATAGGGGTTCCGCGCACATTTCCCCGA

AAAGTGCCACCTGACGTCTAAGAAACCATTATTATCATGACATTAAC

CTATAAAAATAGGCGTATCACGAGGCCCTTTCGTCTCGCGCGTTTCG

GTGATGACGGTGAAAACCTCTGACACATGCAGCTCCCGGAGACGGTC

ACAGCTTGTCTGTAAGCGGATGCCGGGAGCAGACAAGCCCGTCAGGG

CGCGTCAGCGGGTGTTGGCGGGTGTCGGGGCTGGCTTAACTATGCGG

CATCAGAGCAGATTGTACTGAGAGTGCACCATATATGCGGTGTGAAA

TACCGCACAGATGCGTAAGGAGAAAATACCGCATCAGGCGCCTCCTC

AACCTGTATATTCGTAAACCACGCCCAATGGGAGCTGTCTCAGGTTT

GTTCCTGATTGGTTACGGCGCGTTTCGCATCATTGTTGAGTTTTTCC

GCCAGCCCGACGCGCAGTTTACCGGTGCCTGGGTGCAGTACATCAGC

ATGGGCAAATTCTTTCCATCCCGATGATTGTCGCGGGTGTGATCAT

GATGGTCTGGGCATATCGTCGCAGCCCACAGCAACACGTTTCCTGAG

GAACCATGAAACAGTATTTAGAACTGATGCAAAAAGTGCTCGACGAA

GGCACACAGAAAAACGACCGTACCGGAACCGGAACGCTTTCCATTTT

TGGTCATCAGATGCGTTTTAACCTGCAAGATGGATTCCCGCTGGTGA

CAACTAAACGTTGCCACCTGCGTTCCATCATCCATGAACTGCTGTGG

TTTCTGCAGGGCGACACTAACATTGCTTATCTACACGAAAACAATGT

CACCATCTGGGACGAATGGGCCGATGAAAACGGCGACCTCGGGCCAG
```

-continued

```
TGTATGGTAAACAGTGGCGCGCCTGGCCAACGCCAGATGGTCGTCAT
ATTGACCAGATCACTACGGTACTGAACCAGCTGAAAAAcGACCCGGA
TTCGCGCCGCATTATTGTTTCAGCGTGGAACGTAGGCGAACTGGATA
AAATGGCGCTGGCACCGTGCCATGCATTCTTCCAGTTCTATGTGGCA
GACGGCAAACTCTCTTGCCAGCTTTATCAGCGCTCCTGTGACGTCTT
CCTCGGCCTGCCGTTCAACATTGCCAGCTACGCGTTATTGGTGCATA
TGATGGCGCAGCAGTGCGATCTGGAAGTGGGTGATTTTGTCTGGACC
GGTGGCGACACGCATCTGTACAGCAACCATATGGATCAAACTCATCT
GCAATTAAGCCGCGAACCGCGTCCGCTGCCGAAGTTGATTATCAAAC
GTAAACCCGAATCCATCTTCGACTACCGTTTCGAAGACTTTGAGATT
GAAGGCTACGATCCGCATCCGGGCATTAAAGCGCCGGTGGCTATCTA
ATTACGAAACATCCTGCCAGAGCCGACGCCAGTGTGCGTCGGTTTTT
TTACCCTCCGTTAAATTCTTCGAGACGCCTTCCCGAAGGCGCCATTC
GCCATTCAGGCTGCGCAACTGTTGGGAAGGGCGATCGGTGCGGGCCT
CTTCGCTATTACGCCAGCTGGCGAAAGGGGGATGTGCTGCAAGGCGA
TTAAGTTGGGTAACGCCAGGGTTTTCCCAGTCACGACGTTGTAAAAC
GACGGCCAGTGCCAAGCTTTCTTTAATGAAGCAGGGCATCAGGACGG
TATCTTTGTGGAGAAAGCAGAGTAATCTTATTCAGCCTGACTGGTGG
GAAACCACCAGTCAGAATGTGTTAGCGCATGTTGACAAAAATACCAT
TAGTCACATTATCCGTCAGTCGGACGACATGGTAGATAACCTGTTTA
TTATGCGTTTTGATCTTACGTTTAATATTACCTTTATGCGATGAAAC
GGTCTTGGCTTTGATATTCATTTGGTCAGAGATTTGAATGGTTCCCT
GACCTGCCATCCACATTCGCAACATACTCGATTCGGTTCGGCTCAAT
GATAACGTCGGCATATTTAAAAACGAGGTTATCGTTGTCTCTTTTTT
CAGAATATCGCCAAGGATATCGTcGAGAGATTCCGGTTTAATCGATT
TAGAACTGATCAATAAATTTTTTCTGACCAATAGATATTCATCAAAA
TGAACATTGGCAATTGCCATAAAAACGATAAATAACGTATTGGGATG
TTGATTAATGATGAGCTTGATACGCTGACTGTTAGAAGCATCGTGGA
TGAAACAGTCCTCATTAATAAACACCACTGAAGGGCGCTGTGAATCA
CAAGCTATGGCAAGGTCATCAACGGTTTCAATGTCGTTGATTTCTCT
TTTTTTAACCCCTCTACTCAACAGATACCCGGTTAAACCTAGTCGGG
TGTAACTACATAAATCCATAATAATCGTTGACATGGCATACCCTCAC
TCAATGCGTAACGATAATTCCCCTTACCTGAATATTTCATCATGACT
AAACGGAACAACATGGGTCACCTAATGCGCCACTCTCGCGATTTTC
AGGCGGACTTACTATCCCGTAAAGTGTTGTATAATTTGCCTGGAATT
GTCTTAAAGTAAAGTAAATGTTGCGATATGTGAGTGAGCTTAAAACA
AATATTTCGCTGCAGGAGTATCCTGGAAGATGTTCGTAGAAGCTTAC
TGCTCACAAGAAAAAGGCACGTCATCTGACGTGCCTTTTTTATTTG
TACTACCCTGTACGATTACTGCAGCTCGAGTTAGGATACCGGCACTT
TGATCCAACCAGTCGGGTAGATATCCGGTGCTTCGGAGTGCTGGAAC
CAACGGCTCGGCACAATAACAGTCTTATCCATATTAGGGTTCAGCCA
GGCACCCCACCAAGAAAACGTGCTGTTAcAAATGATGTGATGTTTGC
AATGAGACATCAGCATCATATCCTGCCAGGAGTCTTCATCAGTGTTC
CAGTCAATATAAACCGCATTCTGCAGTGGCAGATTTTCTTTAACCCA
CGCGATATCGTCGGAGAAGATATAGTAAGATGGGCTAGCAACACGAC
GGGACATTTCCGCGATAGCATTCTGGTAATACGGCAGCTGGCACACG
GAACCGGTAGTAGCCCAGTGTTTCGGCTGCAGATAGTCACCACGACG
AATGTGCAGGGAAACCGCGTTTTCATCTTTGTCCAGGATTTCCAGCA
TGTTCAGGCTGCGGGAATTTGCTTTGTTCTTATCAAAGGTGAAGGAT
TCACGCACTTCGTCTTTGATATCAGCGAAGAAACGCTCGCTCTGATA
GAAACCTTTAAAGTACAGCAGCGGCCAGAAATACTTCTTCTCGAACG
CACGCAGAGAGTTCGGCGCCTGCTTGCGTTCGTAGATTTTTTAAAA
AACAGGAATTCGATAACTTTTTTCAGCGGTTGGTTGATGCAGAATTC
GGTGTGCGGCAGGTTGAACACGCGGTGCATTTCGTAACCGTAATGGA
CTTTGTAATGCATCATGTCGCTCAGGTCGATACGGACCTTCGGGTAA
TACTTTTTCATACGCAGATAGAAAGCATAGATAAACATCTGGTTGCC
CAGACCGCCAGTCACTTTGATCAGACGCATTATATCTCCTTCTTG
```

Fucosylated oligosaccharides produced by metabolically engineered E. coli cells are purified from culture broth post-fermentation. An exemplary procedure comprises five steps. (1) Clarification: Fermentation broth is harvested and cells removed by sedimentation in a preparative centrifuge at 6000×g for 30 min. Each bioreactor run yields about 5-7 L of partially clarified supernatant. (2) Product capture on coarse carbon: A column packed with coarse carbon (Calgon 12×40 TR) of ~1000 ml volume (dimension 5 cm diameter× 60 cm length) is equilibrated with 1 column volume (CV) of water and loaded with clarified culture supernatant at a flow rate of 40 ml/min. This column has a total capacity of about 120 g of sugar. Following loading and sugar capture, the column is washed with 1.5 CV of water, then eluted with 2.5 CV of 50% ethanol or 25% isopropanol (lower concentrations of ethanol at this step (25-30%) may be sufficient for product elution.) This solvent elution step releases about 95% of the total bound sugars on the column and a small portion of the color bodies. In this first step capture of the maximal amount of sugar is the primary objective. Resolution of contaminants is not an objective. (3) Evaporation: A volume of 2.5 L of ethanol or isopropanol eluate from the capture column is rotary-evaporated at 56° C. and a sugar syrup in water is generated. Alternative methods that could be used for this step include lyophilization or spray-drying. (4) Flash chromatography on fine carbon and ion exchange media: A column (GE Healthcare HiScale50/40, 5×40 cm, max pressure 20 bar) connected to a Biotage Isolera One FLASH Chromatography System is packed with 750 ml of a Darco Activated Carbon G60 (100-mesh): Celite 535 (coarse) 1:1 mixture (both column packings were obtained from Sigma). The column is equilibrated with 5 CV of water and loaded with sugar from step 3 (10-50 g, depending on the ratio of 2'-FL to contaminating lactose), using either a celite loading cartridge or direct injection. The column is connected to an evaporative light scattering (ELSD) detector to detect peaks of eluting sugars during the chromatography. A four-step gradient of isopropanol, ethanol or methanol is run in order to separate 2'-FL from monosaccharides (if present), lactose and color bodies. Fractions corresponding to sugar peaks are collected automatically in 120-ml bottles, pooled and directed to step 5. In certain purification runs from longer-than-normal fermentations, passage of the 2'-FL-containing fraction through anion-exchange and cation exchange columns can remove excess protein/DNA/caramel body contaminants. Resins tested successfully for this purpose are Dowex 22.

The gene screening approach described herein was successfully utilized to identify new α(1,2) FTs for the efficient biosynthesis of 2'-FL in metabolically engineered *E. coli* host strains. The results of the screen are summarized in Table 1.

Production Host Strains

*E. coli* K-12 is a well-studied bacterium which has been the subject of extensive research in microbial physiology and genetics and commercially exploited for a variety of industrial uses. The natural habitat of the parent species, *E. coli*, is the large bowel of mammals. *E. coli* K-12 has a history of safe use, and its derivatives are used in a large number of industrial applications, including the production of chemicals and drugs for human administration and consumption. *E. coli* K-12 was originally isolated from a convalescent diphtheria patient in 1922. Because it lacks virulence characteristics, grows readily on common laboratory media, and has been used extensively for microbial physiology and genetics research, it has become the standard bacteriological strain used in microbiological research, teaching, and production of products for industry and medicine. *E. coli* K-12 is now considered an enfeebled organism as a result of being maintained in the laboratory environment for over 70 years. As a result, K-12 strains are unable to colonize the intestines of humans and other animals under normal conditions. Additional information on this well known strain is available at http://epa.gov/oppt/biotech/pubs/fra/fra004.htm. In addition to *E. coli* K12, other bacterial strains are used as production host strains, e.g., a variety of bacterial species may be used in the oligosaccharide biosynthesis methods, e.g., *Erwinia herbicola* (*Pantoea agglomerans*), *Citrobacter freundii*, *Pantoea citrea*, *Pectobacterium carotovorum*, or *Xanthomonas campestris*. Bacteria of the genus *Bacillus* may also be used, including *Bacillus subtilis*, *Bacillus licheniformis*, *Bacillus coagulans*, *Bacillus thermophilus*, *Bacillus laterosporus*, *Bacillus megaterium*, *Bacillus mycoides*, *Bacillus pumilus*, *Bacillus lentus*, *Bacillus cereus*, and *Bacillus circulans*. Similarly, bacteria of the genera *Lactobacillus* and *Lactococcus* may be modified using the methods of this invention, including but not limited to *Lactobacillus acidophilus*, *Lactobacillus salivarius*, *Lactobacillus plantarum*, *Lactobacillus helveticus*, *Lactobacillus delbrueckii*, *Lactobacillus rhamnosus*, *Lactobacillus bulgaricus*, *Lactobacillus crispatus*, *Lactobacillus gasseri*, *Lactobacillus casei*, *Lactobacillus reuteri*, *Lactobacillus jensenii*, and *Lactococcus lactis*. *Streptococcus thermophiles* and *Proprionibacterium freudenreichii* are also suitable bacterial species for the invention described herein. Also included as part of this invention are strains, modified as described here, from the genera *Enterococcus* (e.g., *Enterococcus faecium* and *Enterococcus thermophiles*), *Bifidobacterium* (e.g., *Bifidobacterium longum*, *Bifidobacterium infantis*, and *Bifidobacterium bifidum*), *Sporolactobacillus* spp., *Micromomospora* spp., *Micrococcus* spp., *Rhodococcus* spp., and *Pseudomonas* (e.g., *Pseudomonas fluorescens* and *Pseudomonas aeruginosa*).

Suitable host strains are amenable to genetic manipulation, e.g., they maintain expression constructs, accumulate precursors of the desired end product, e.g., they maintain pools of lactose and GDP-fucose, and accumulate endproduct, e.g., 2'-FL. Such strains grow well on defined minimal media that contains simple salts and generally a single carbon source. The strains engineered as described above to produce the desired fucosylated oligosaccharide(s) are grown in a minimal media. An exemplary minimal medium used in a bioreactor, minimal "FERM" medium, is detailed below.

Ferm (10 liters): Minimal medium comprising:
40 g $(NH_4)_2HPO_4$
100 g $KH_2PO_4$
10 g $MgSO_4.7H_2O$
40 g NaOH
1× Trace elements:
1.3 g NTA (nitrilotriacetic acid)
0.5 g $FeSO_4.7H_2O$
0.09 g $MnCl_2.4H_2O$
0.09 g $ZnSO_4.7H_2O$
0.01 g $CoCl_2.6H_2O$
0.01 g $CuCl_2.2H_2O$
0.02 g $H_3BO_3$
0.01 g $Na_2MoO_4.2H_2O$ (pH 6.8)
Water to 10 liters
DF204 antifoam (0.1 ml/L)
150 g glycerol (initial batch growth), followed by fed batch mode with a 90% glycerol-1% $MgSO_4$-1× trace elements feed, at various rates for various times.

A suitable production host strain is one that is not the same bacterial strain as the source bacterial strain from which the fucosyltransferase-encoding nucleic acid sequence was identified.

Bacteria comprising the characteristics described herein are cultured in the presence of lactose, and a fucosylated oligosaccharide is retrieved, either from the bacterium itself or from a culture supernatant of the bacterium. The fucosylated oligosaccharide is purified for use in therapeutic or nutritional products, or the bacteria are used directly in such products.

EXAMPLES

Example 1: Identification of Novel α(1,2) Fucosyltransferases

To identify additional novel α(1,2)fucosyltransferases, a multiple sequence alignment query was generated using the alignment algorithm of the CLCbio Main Workbench package, version 6.9 (CLCbio, 10 Rogers Street #101, Cambridge, Mass. 02142, USA) using four previously identified lactose-utilizing α(1,2)fucosyltransferase protein sequences: *H. pylori* futC (SEQ ID NO: 1), *H. mustelae* FutL (SEQ ID NO: 2), *Bacteroides vulgatus* futN (SEQ ID NO: 3), and *E. coli* 0126 wbgL (SEQ ID NO: 4). This sequence alignment and percentages of sequence identity between the four previously identified lactose-utilizing α(1,2)fucosyltransferase protein sequences is shown in FIG. 3. An iterative PSI-BLAST was performed, using the FASTA-formatted multiple sequence alignment as the query, and the NCBI PSI-BLAST program run on a local copy of NCBI BLAST+ version 2.2.29. An initial position-specific scoring matrix file (.pssm) was generated by PSI-BLAST, which was then used to adjust the score of iterative homology search runs. The process is iterated to generate an even larger group of candidates, and the results of each run were used to further refine the matrix.

A portion of the initial position-specific scoring matrix file used is shown below:

| | | A | R | N | D | C | Q | E | G | H | I | L | K | M | F | P | S | T | W | Y | V |
|---|---|---|---|---|---|---|---|---|---|---|---|---|---|---|---|---|---|---|---|---|---|
| | | | | | | | | Last position-specific scoring matrix computed | | | | | | | | | | | | | |
| 1 | M | -1 | -1 | -2 | -3 | -2 | 0 | -2 | -3 | -2 | 1 | 2 | -1 | 6 | 0 | -3 | -2 | -1 | -2 | -1 | 1 |
| 2 | A | 2 | -2 | 0 | 4 | -2 | -1 | 1 | -1 | -1 | -2 | -3 | -1 | -2 | -3 | -1 | 1 | -1 | -3 | -3 | -1 |
| 3 | F | -2 | -3 | -3 | -4 | -3 | -3 | -3 | -3 | -1 | 0 | 0 | -3 | 0 | 7 | -4 | -3 | -2 | 1 | 3 | -1 |
| 4 | K | 0 | 3 | 0 | -1 | -2 | 1 | 0 | -1 | -1 | -3 | -3 | 3 | -2 | -3 | -1 | 2 | 0 | -3 | -2 | -2 |
| 5 | V | -1 | -3 | -3 | -4 | -1 | -3 | -3 | -4 | -3 | 4 | 2 | -3 | 1 | 0 | -3 | -2 | -1 | -3 | -1 | 3 |
| 6 | V | -1 | -3 | -3 | -3 | -1 | -3 | -3 | -4 | -3 | 4 | 1 | -3 | 1 | -1 | -3 | -2 | 0 | -3 | -1 | 3 |
| 7 | Q | -1 | 4 | 0 | -1 | -3 | 4 | 1 | -2 | 0 | -3 | -2 | 3 | -1 | -3 | -1 | -1 | -1 | -3 | -2 | -3 |
| 8 | I | -1 | -3 | -3 | -4 | -1 | -2 | -3 | -4 | -3 | 3 | 2 | -3 | 1 | 0 | -3 | -2 | -1 | -3 | -1 | 3 |
| 9 | C | -1 | -1 | 0 | -1 | 5 | 3 | 0 | -2 | 4 | -2 | -2 | 0 | -1 | -2 | -2 | 0 | 2 | -2 | -1 | -1 |
| 10 | G | 0 | -3 | -1 | -1 | -3 | -2 | -2 | 6 | -2 | -4 | -4 | -2 | -3 | -3 | -2 | 0 | -2 | -3 | -3 | -3 |
| 11 | G | 0 | -3 | -1 | -1 | -3 | -2 | -2 | 6 | -2 | -4 | -4 | -2 | -3 | -3 | -2 | 0 | -2 | -3 | -3 | -3 |
| 12 | L | -2 | -2 | -4 | -4 | -1 | -2 | -3 | -4 | -3 | 2 | 4 | -3 | 2 | 0 | -3 | -3 | -1 | -2 | -1 | 1 |
| 13 | G | 0 | -3 | -1 | -1 | -3 | -2 | -2 | 6 | -2 | -4 | -4 | -2 | -3 | -3 | -2 | 0 | -2 | -3 | -3 | -3 |
| 14 | N | -2 | -1 | 6 | 1 | -3 | 0 | 0 | -1 | 1 | -4 | -4 | 0 | -2 | -3 | -2 | 1 | 0 | -4 | -2 | -3 |
| 15 | Q | -1 | 1 | 0 | 0 | -3 | 6 | 2 | -2 | 0 | -3 | -2 | 1 | -1 | -3 | -1 | 0 | -1 | -2 | -2 | -2 |
| 16 | M | -1 | -2 | -3 | -4 | -2 | -1 | -2 | -3 | -2 | 1 | 3 | -2 | 5 | 0 | -3 | -2 | -1 | -2 | -1 | 1 |
| 17 | F | -2 | -3 | -3 | -4 | -3 | -3 | -4 | -3 | -1 | 0 | 0 | -3 | 0 | 7 | -4 | -3 | -2 | 1 | 3 | -1 |
| 18 | Q | -1 | 0 | -1 | -1 | -3 | 5 | 1 | -2 | 0 | 1 | -1 | 1 | 0 | -2 | -2 | -1 | -1 | -2 | -2 | 0 |
| 19 | Y | -2 | -2 | -3 | -3 | -3 | -2 | -3 | -3 | 1 | -1 | -1 | -2 | -1 | 5 | -3 | -2 | -2 | 2 | 6 | -1 |
| 20 | A | 4 | -1 | -1 | -1 | -1 | -1 | -1 | 0 | -2 | -2 | -2 | -1 | -1 | -2 | -1 | 2 | 0 | -3 | -2 | -1 |
| 21 | F | -2 | -3 | -3 | -4 | -3 | -3 | -4 | -3 | -1 | 0 | 0 | -3 | 0 | 7 | -4 | -3 | -2 | 1 | 3 | -1 |
| 22 | A | 3 | -2 | -1 | -2 | -1 | -1 | -1 | 4 | -2 | -2 | -2 | -1 | -2 | -3 | -1 | 1 | -1 | -3 | -2 | -1 |
| 23 | K | -1 | 0 | -1 | -2 | -3 | 0 | -1 | -3 | 1 | -2 | -2 | 3 | -1 | 2 | -2 | -1 | -1 | 1 | 6 | -2 |
| 24 | S | 2 | -1 | -1 | -2 | -1 | -1 | -1 | -1 | -2 | -1 | 1 | -1 | 0 | -1 | 3 | 0 | -3 | -2 | 0 |
| 25 | L | -2 | 3 | -2 | -3 | -2 | -1 | -2 | -3 | -2 | 1 | 3 | 0 | 1 | 0 | -3 | -2 | -1 | -2 | -1 | 0 |
| 26 | Q | 0 | 0 | 0 | -1 | -2 | 4 | 1 | -2 | -1 | -1 | 0 | 0 | 3 | -2 | -2 | 2 | 0 | -2 | -2 | -1 |
| 27 | K | -1 | 2 | 0 | -1 | -3 | 1 | 0 | -2 | -1 | -2 | -2 | 4 | -1 | -3 | -1 | 0 | 2 | -3 | -2 | -2 |
| 28 | H | -1 | 0 | 0 | -2 | -3 | 0 | 0 | -2 | 6 | 1 | -1 | -2 | -1 | -1 | -2 | -1 | -1 | -3 | 0 | 0 |
| 29 | S | -1 | -1 | 3 | -1 | -2 | -1 | -1 | -2 | 0 | -1 | 1 | -1 | 0 | 1 | -2 | 1 | 0 | 0 | 4 | -1 |
| 30 | H | -1 | -1 | 4 | 0 | -3 | -1 | -1 | 3 | 0 | -3 | -3 | -1 | -2 | 0 | -3 | 0 | -1 | -1 | 4 | -3 |
| 31 | T | -1 | -2 | -1 | -2 | -2 | -1 | -2 | -2 | -2 | 1 | -1 | -1 | -1 | -2 | 5 | 0 | 3 | -3 | -2 | 0 |
| 32 | P | -1 | 1 | 0 | -2 | -1 | -3 | 0 | -1 | -2 | -2 | -3 | -2 | -2 | -4 | 7 | -1 | -1 | -4 | -3 | -3 |
| 33 | V | -1 | -3 | -3 | -4 | -1 | -2 | -3 | -4 | -3 | 2 | 2 | -3 | 1 | -1 | -3 | -2 | 0 | -3 | -1 | 4 |
| 34 | L | -2 | 3 | -2 | -3 | -2 | -1 | -2 | -3 | 0 | 0 | 2 | 0 | 1 | 1 | -3 | -2 | -1 | 0 | 4 | -1 |
| 35 | L | -2 | -3 | -4 | -4 | -2 | -3 | -3 | -4 | -3 | 3 | 3 | -3 | 1 | 3 | -3 | -3 | -1 | -1 | 1 | 1 |
| 36 | D | -2 | -2 | 1 | 6 | -4 | 0 | 1 | -2 | -1 | -4 | -4 | -1 | -3 | -4 | -2 | 0 | -1 | -5 | -3 | -4 |

The command line of PSI-BLAST that was used is as follows: psiblast-db<LOCAL NR database name>-max_target_seqs 2500-in_msa<MSA file in FAST format>-out-outfmt "7sskingdoms sscinames scomnames sseqid stitle evalue length pident"-out_pssm<PSSM file output>-out_ascii_pssm<PSSM (ascii) output>-num_iterations 6-num_threads 8

This PSI-BLAST search resulted in an initial 2515 hits. There were 787 hits with greater than 22% sequence identity to FutC. 396 hits were of greater than 275 amino acids in length. Additional analysis of the hits was performed, including sorting by percentage identity to FutC, comparing the sequences by BLAST to an existing α(1,2) fucosyltransferase inventory (of known α(1,2) fucosyltransferases, to eliminate known lactose-utilizing enzymes and duplicate hits), and manual annotation of hits to identify those originating from bacteria that naturally exist in the gastrointestinal tract. An annotated list of the novel α(1,2) fucosyltransferases identified by this screen are listed in Table 1. Table 1 provides the bacterial species from which the enzyme is found, the GenBank Accession Number, GI Identification Number, amino acid sequence, and % sequence identity to FutC.

Multiple sequence alignment of the 4 known α(1,2) FTs used for the PSI-BLAST query and 12 newly identified α(1,2) FTs is shown in FIG. 4.

Example 2: Validation of Novel α(1,2) FTs

To test for lactose-utilizing fucosylatransferase activity, the production of fucosylated oligossacharides (i.e., 2'-FL) is evaluated in a host organism that expresses the candidate enzyme (i.e., syngene) and which contains both cytoplasmic GDP-fucose and lactose pools. The production of fucosylated oligosaccharides indicates that the candidate enzyme-encoding sequence functions as a lactose-utilizing α(1,2) fucosyltransferase. Of the identified hits, 12 novel α(1,2) fucosyltransferases were further analyzed for their functional capacity to produce 2'-fucosyllactose: *Prevotella melaninogenica* FutO, *Clostridium bolteae* FutP, *Clostridium bolteae*+13 FutP, *Lachnospiraceae* sp. FutQ, *Methanosphaerula palustries* FutR, *Tannerella* sp. FutS, *Bacteroides caccae* FutU, *Butyrivibrio* FutV, *Prevotellaa* sp. FutW, *Parabacteroides johnsonii* FutX, *Akkermansia muciniphilia* FutY, *Salmonella enterica* FutZ, and *Bacteroides* sp. FutZA.

Figure 5A:
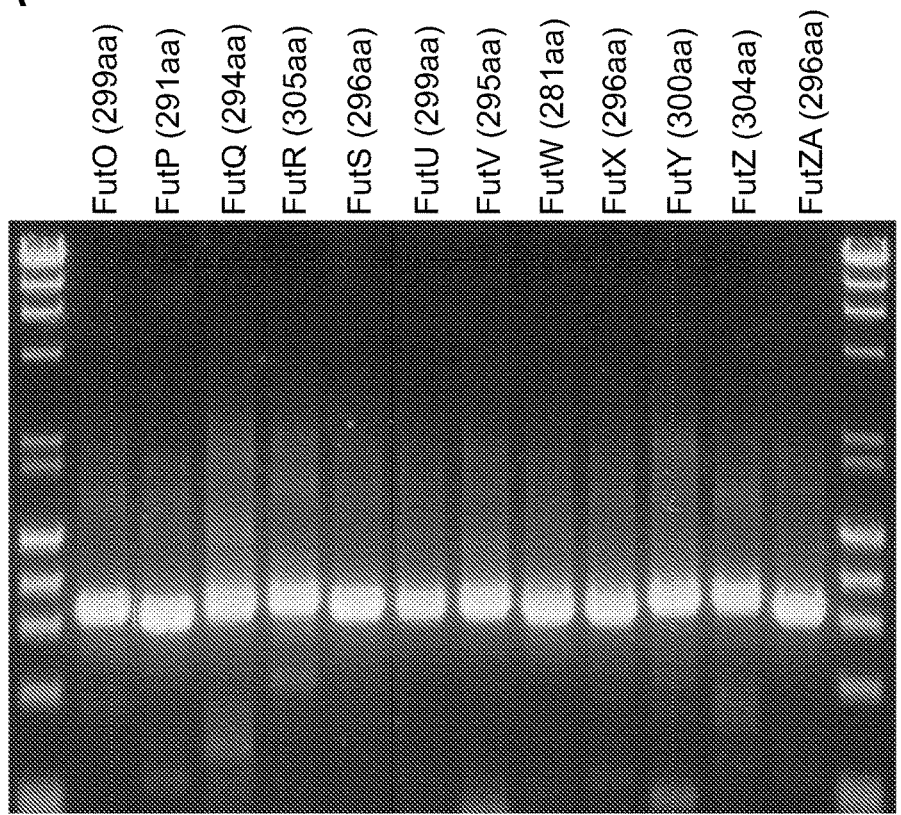
FIG. 5A and FIG. 5B are two pictures of gels showing the construction of the syngenes for each of the 12 novel α(1,2)-fucosyltransferases.
Figure 5B:
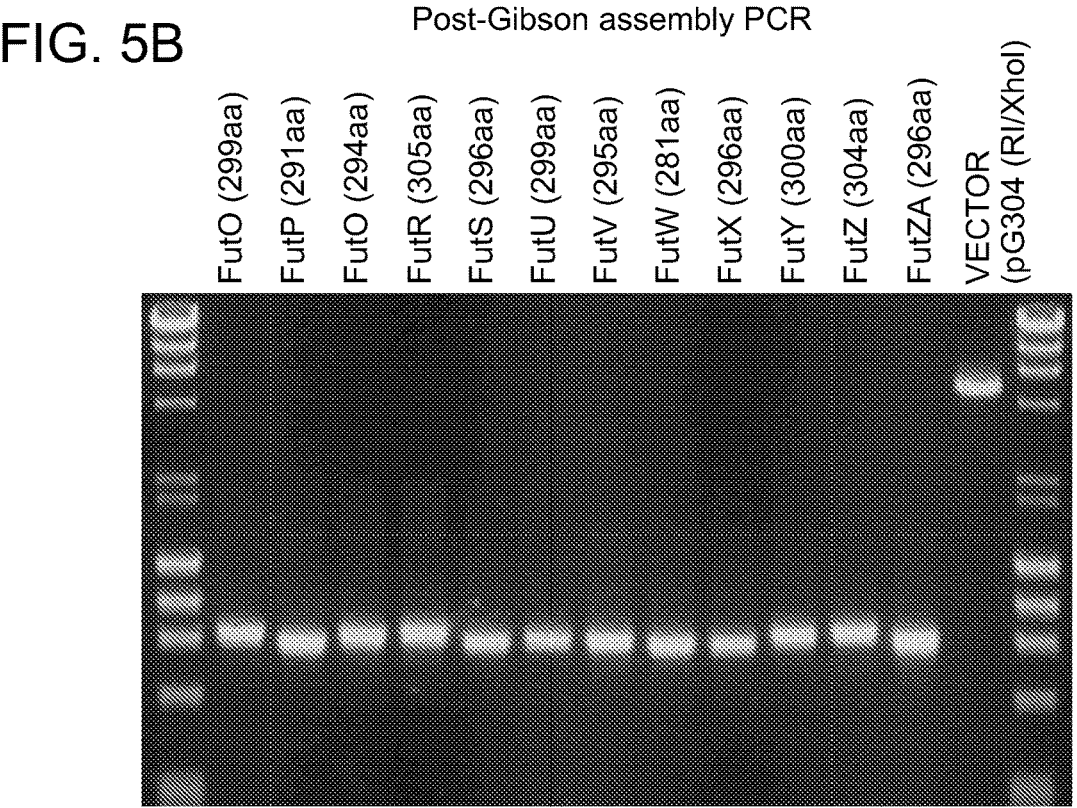

Syngenes were constructed comprising the 12 novel α(1,2) FTs in the configuration as follows: EcoRI-T7g10 RBS-syngene-XhoI. FIG. 5A and FIG. 5B show the syngene fragments after PCR assembly and gel-purification.

The candidate α(1,2) FTs (i.e., syngenes) were cloned by standard molecular biological techniques into an exemplary expression plasmid pEC2-(T7)-Fut syngene-rcsA-thyA. This plasmid utilizes the strong leftwards promoter of bacteriophage λ (termed $P_L$) to direct expression of the candidate genes (Sanger, F. et al. (1982). J Mol Biol 162, 729-773). The promoter is controllable, e.g., a trp-cI construct is stably integrated the into the *E. coli* host's genome (at the ampC locus), and control is implemented by adding tryptophan to the growth media. Gradual induction of protein expression is accomplished using a temperature sensitive cI repressor. Another similar control strategy (temperature independent expression system) has been described (Mieschendahl et al., 1986, Bio/Technology 4:802-808). The plasmid also carries the *E. coli* rcsA gene to up-regulate GDP-fucose synthesis, a critical precursor for the synthesis of fucosyl-linked oligosaccharides. In addition, the plasmid carries a β-lactamase (bla) gene for maintaining the plasmid in host strains by ampicillin selection (for convenience in the laboratory) and a native thyA (thymidylate synthase) gene as an alternative means of selection in thyA⁻ hosts.

The expression constructs were transformed into a host strain useful for the production of 2'-FL. The host strain used to test the different α(1,2) FT candidates incorporates all the above genetic modifications described above and has the following genotype:
ΔampC::$P_{trp}^{B}$cI, Δ(lacI-lacZ)::FRT, $P_{lacIq}$lacY⁺, ΔwcaJ::FRT, thyA::Tn10, Δlon:(npt3, lacZ⁺), ΔlacA The *E. coli* strains harboring the different α(1,2) FT candidate expression plasmids were analyzed. Strains were grown in selective media (lacking thymidine) to early exponential phase. Lactose was then added to a final concentration of 0.5%, and tryptophan (200 µM) was added to induce expression of each candidate α(1,2) FT from the $P_L$ promoter. At the end of the induction period (~24 h) the culture supernatants and cells were harvested. Heat extracts were prepared from whole cells and the equivalent of 0.2OD$_{600}$ units of each strain analyzed for the presence of 2'-FL by thin layer chromatography (TLC), along with 2 µl of the corresponding clarified culture supernatant for each strain.

FIG. 6 shows the oligosaccharides produced by the α(1,2) FT-expressing bacteria, as determined by TLC analysis of the culture supernatant and extracts from the bacterial cells. 2'FL was produced by exogenous expression of WbgL (used as control), FutO, FutP, FutQ, FutR, FutS, FutU, FutW, FutX, FutZ, and FutZA.

Figure 7:
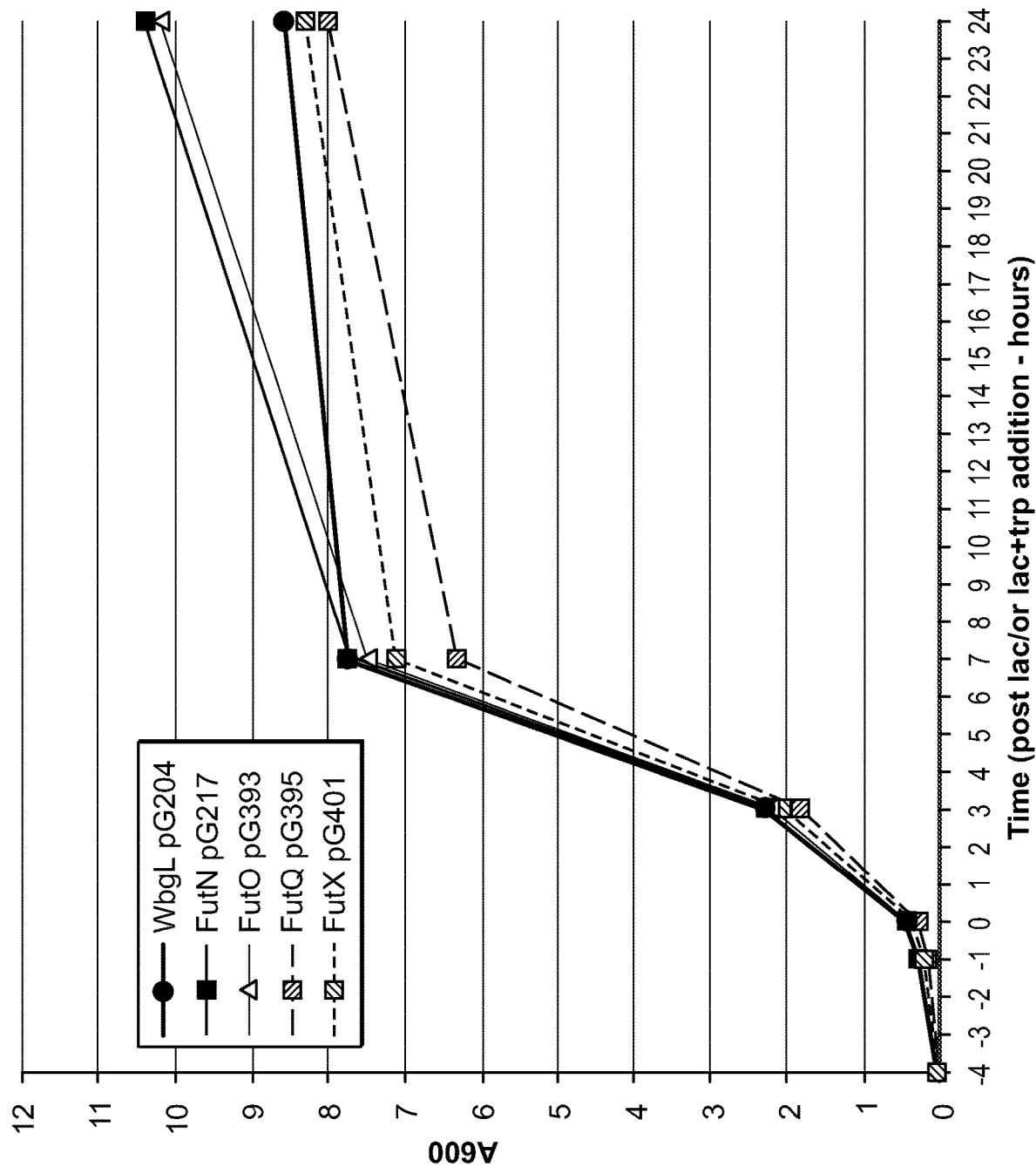
FIG. 7 is a graph showing the growth curve of the host bacterium expressing plasmids containing the α(1,2) fucosyltransferase genes WbgL, FutN, FutO, FutQ, and FutX after tryptophan induction in the presence of lactose in the culture medium (i.e. lac+trp).

Table 4 summarizes the fucosyltransferase activity for each candidate syngene as determined by the 2'FL synthesis screen described above. 11 of the 12 candidate α(1,2) FTs were found to have lactose-utilizing fucosyltransferase activity.

α(1,2) FTs FutO (plasmid pG393), FutQ (plasmid pG395), and FutX (pG401) were introduced into host bacterial strains. For example, the host strains utilized has the following genotype: ΔampC::$P_{trp}^{B}$cI, Δ(lacI-lacZ)::FRT, $P_{lacIq}$lacY⁺, ΔwcaJ::FRT, thyA::Tn10, Δlon:(npt3, lacZ⁺), ΔlacA Bacterial cultures expressing each exogenous fucosyltransferase were induced by addition of tryptophan (to induce expression of the exogenous fucosyltransferases) in the presence of lactose. Growth of the cultures was monitored by spectrophotometric readings at A600 at the following timepoints: 4 hours and 1 hour before induction, at the time of induction (time 0), and 3 hours, 7 hours, and 24 hours after induction. The results are shown in FIG. 7, and indicate that expression of the exogenous fucosyltransferase did not prevent cell proliferation. Furthermore, the growth curve for the bacterial cultures expressing the novel α(1,2) fucosyltransferases FutO, FutQ, and FutX is similar to those expressing the known α(1,2)FT enzymes WbgL and FutN.

Figure 8:
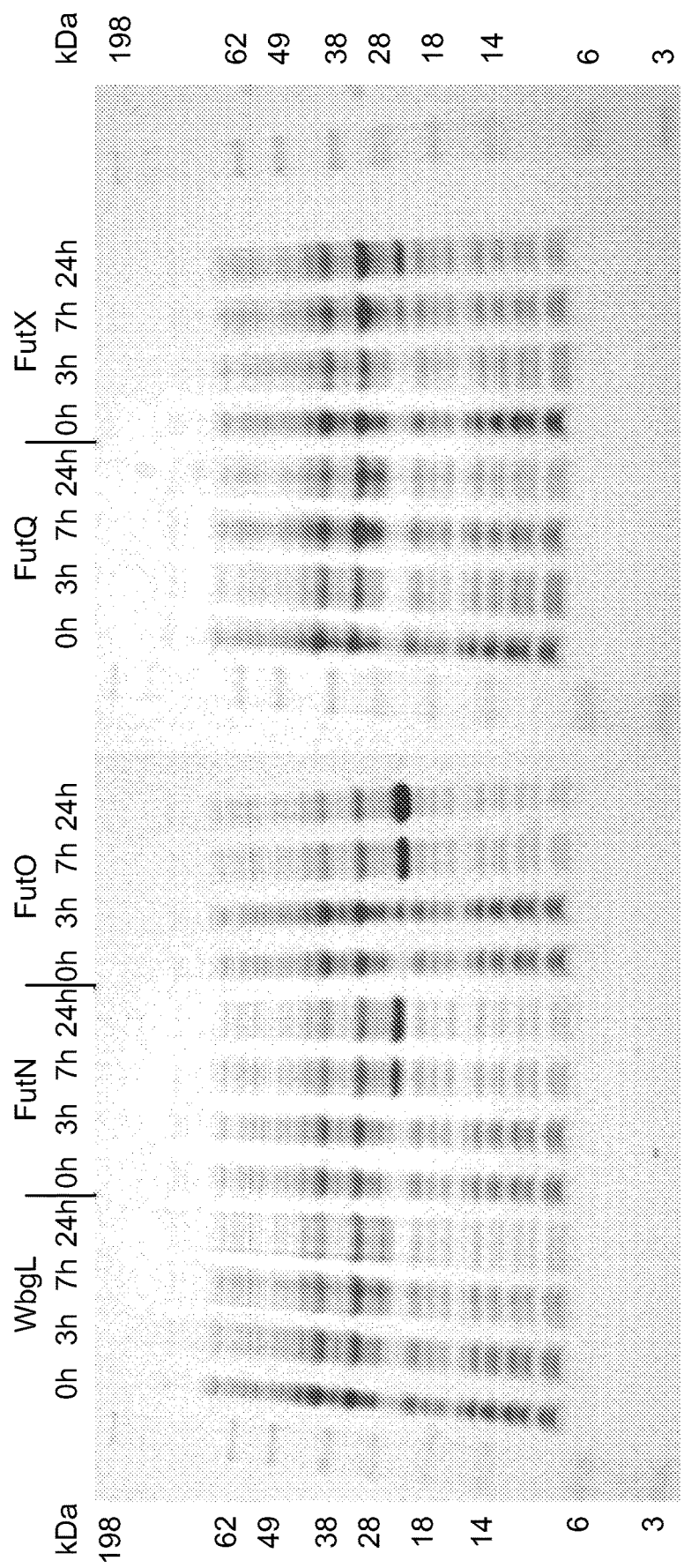
FIG. 8 is a photograph of a SDS-PAGE gel showing the proteins produced from host bacterium expressing α(1,2) fucosyltransferase genes WbgL, FutN, FutO, FutQ, and FutX after induction.

Protein expression was also assessed for the bacterial cultures expressing each fucosyltransferase after induction. Cultures were induced as described previously, and protein lysates were prepared from the bacterial cultures at the time of induction (0 hours), 3 hours, 7 hours, and 24 hours after induction. The protein lysates were run on an SDS-PAGE gel and stained to examine the distribution of proteins at each time point. As shown in FIG. 8, induction at 7 hours and 24 hours showed increases in a protein band at around 20-28 kDa for bacterial cultures expressing exogenous FutN, FutO, and FutX. These results indicate that induction results in significant expression of the exogenous fucosyltransferases.

Figure 9A:
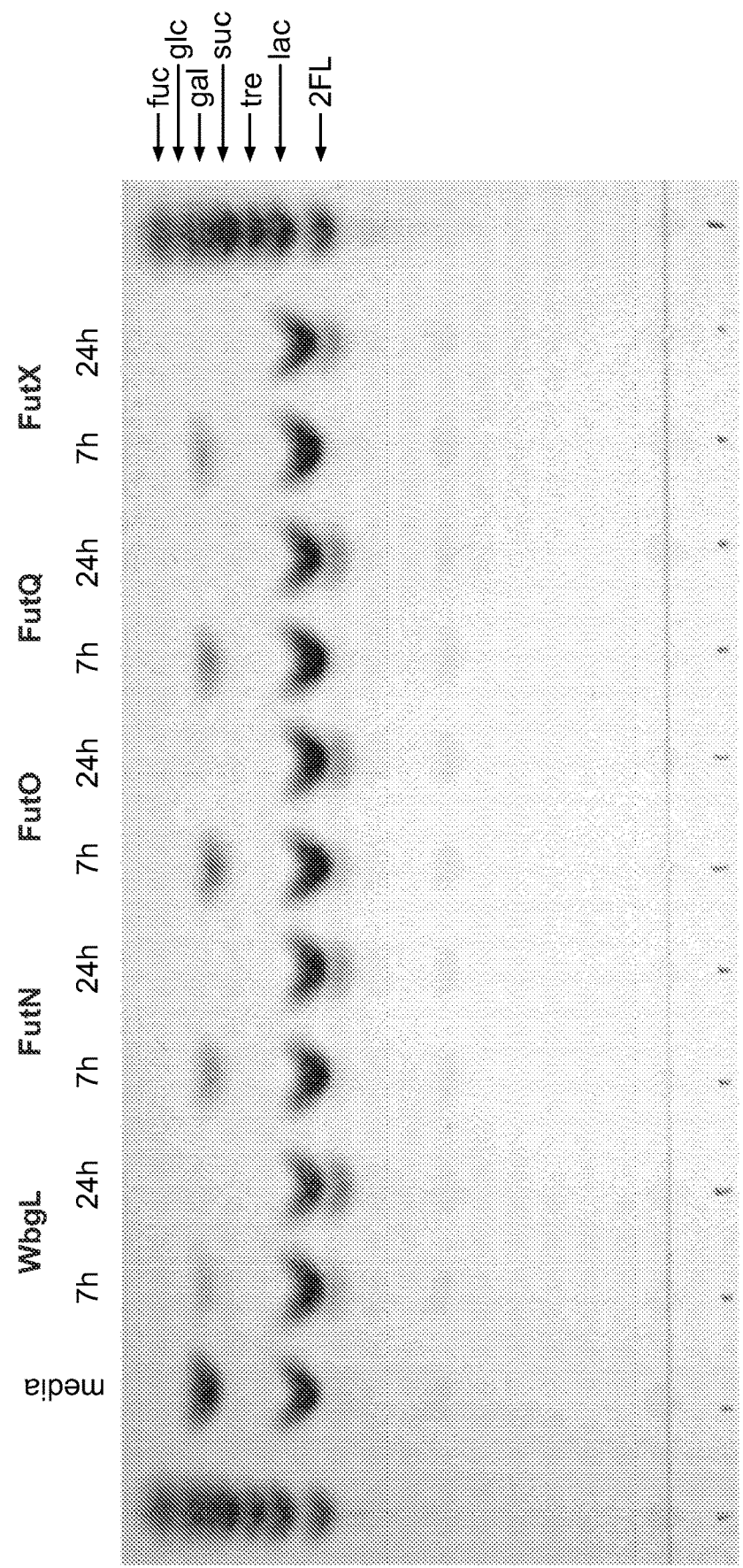
FIG. 9A and FIG. 9B are two photographs of thin layer chromatograms showing the production of fucosylated oligosaccharide products from in *E. coli* cultures expressing select α(1,2)-fucosyltransferase syngenes WbgL, FutN, FutO, FutQ, and FutX at 7 hours or 24 hours after induction.
Figure 9B:
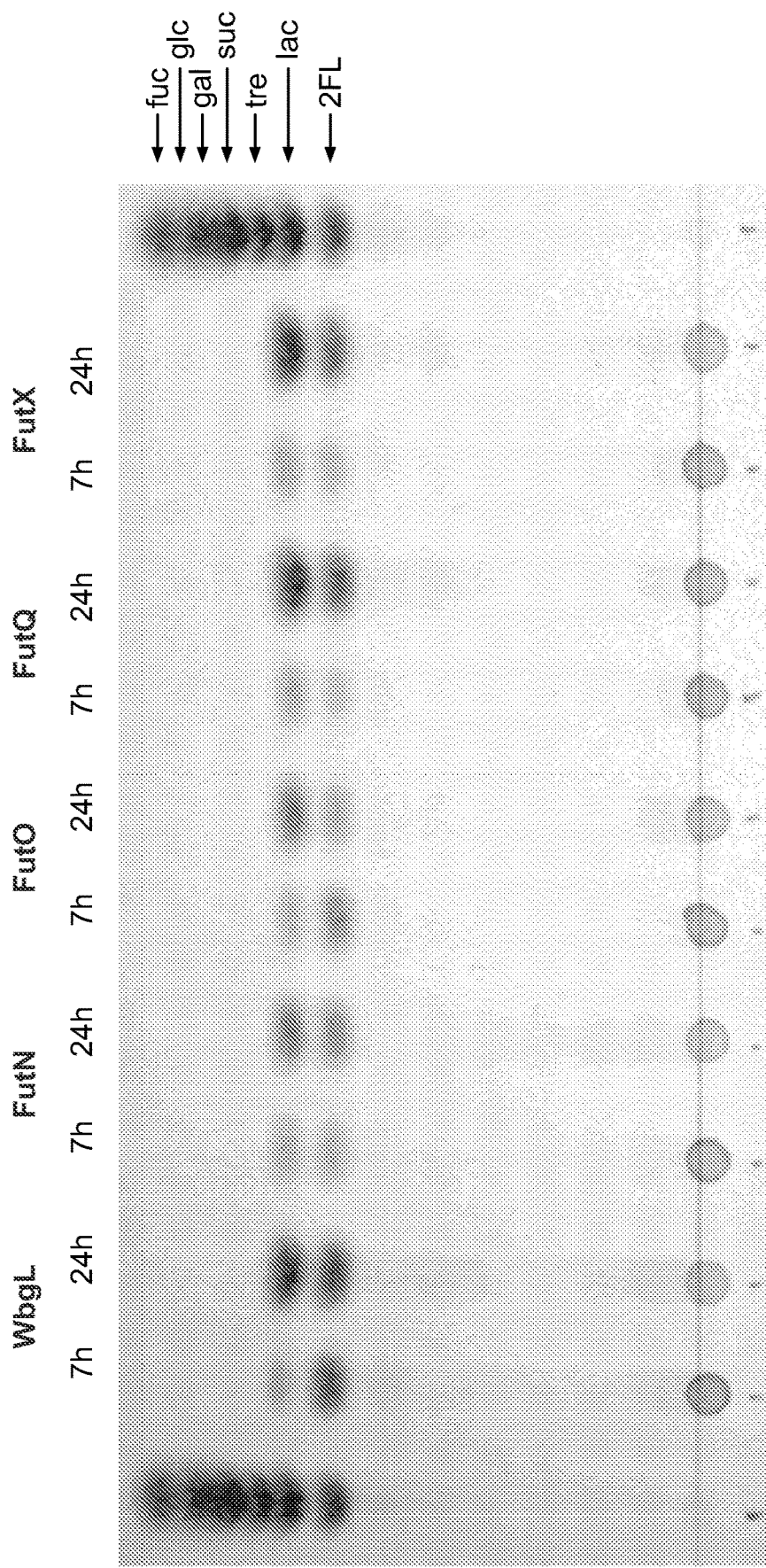

Finally, additional TLC analysis to assess the efficiency and yield of 2'FL production in bacterial cultures expressing novel α(1,2) FTs FutO, FutQ, and FutX compared to known fucosyltransferases WbgL and FutN. Cultures were induced at 7 hours and 24 hours, and run out on TLC. FIG. 9A shows the level of 2'FL in the cell supernatant. The level of 2'FL found in the bacterial cells were also examined. As shown in FIG. 9B, 2'FL was produced in cell lysates from bacteria expressing the novel α(1,2) FTs FutO, FutQ, and FutX at 7 hours and 24 hours after induction.

TABLE 4

2'FL synthesis screen results

|  | syngene | 24 h OD (induced) | 2'-FL culture medium | 2'-FL cell extract |  |  |
| --- | --- | --- | --- | --- | --- | --- |
| *Escherichia coli* | WbgL | 9.58 | 5 | 5 | pG204 pEC2-WbgL-rcsA-thyA | E640 |
| *Prevotella melaninogenica* | FutO | 12.2 | 3 | 2 | pG393 pEC2-(T7)FutO-rcsA-thyA | E985 |
| *Clostridium bolteae* | FutP | 10.4 | 1 | 2 | pG394 pEC2-(T7)FutP-rcsA-thyA | E986 |
| *Lachnospiraceae sp.* | FutQ | 10.6 | 3 | 4 | pG395 pEC2-(T7)FutQ-rcsA-thyA | E987 |
| *Methanosphaerula palustris* | FutR | 11.9 | 0 | 1 | pG396 pEC2-(T7)FutR-rcsA-thyA | E988 |
| *Tannerella sp.* | FutS | 11.3 | 2 | 3 | pG397 pEC2-(T7)FutS-rcsA-thyA | E989 |
| *Bacteroides caccae* | FutU | 12.1 | 0 | 2 | pG398 pEC2-(T7)FutU-rcsA-thyA | E990 |
| *Butyrlvibrio* | FutV | 11.3 | 0 | 1 | pG399 pEC2-(T7)FutV-rcsA-thyA | E991 |
| *Prevotella sp.* | FutW | 10.5 | 3 | 3 | pG400 pEC2-(T7)FutW-rcsA-thyA | E992 |
| *Parabacteroides johnsonii* | FutX | 10.7 | 3 | 5 | pG401 pEC2-(T7)FutX-rcsA-thyA | E993 |
| *Akkermansia muciniphilia* | FutY | 9.1 | 0 | 0 | pG402 pEC2-(T7)FutY-rcsA-thyA | E994 |
| *Salmonella enterica* | FutZ | 11.0 | 0 | 3 | pG403 pEC2-(T7)FutZ-rcsA-thyA | E995 |
| *Bacteroides sp.* | FutZA | 9.9 | 3 | 3 | pG404 pEC2-(T7)FutZA-rcsA-thyA | E996 |

Example 3: Characterization of Cultures Expressing Novel α(1,2) FTs

Further characterization of the bacterium expressing novel α(1,2) FTs FutO, FutQ, and FutX was performed. Specifically, proliferation rate and exogenous α(1,2) FT expression was examined.

Expression plasmids containing fucosyltransferases WbgL (plasmid pG204), FutN (plasmid pG217), and novel Example 4: FutN Exhibits Increased Efficiency for Production of 2'FL Fucosylated oligosaccharides produced by metabolically engineered *E. coli* cells to express *B. vulgatus* FutN was purified from culture broth post-fermentation.

Fermentation broth was harvested and cells were removed by sedimentation in a preparative centrifuge at 6000×g for 30 min. Each bioreactor run yields about 5-7 L of partially clarified supernatant. A column packed with coarse carbon (Calgon 12×40 TR) of ~1000 ml volume (dimension 5 cm diameter×60 cm length) was equilibrated with 1 column volume (CV) of water and loaded with clarified culture supernatant at a flow rate of 40 ml/min. This column had a total capacity of about 120 g of sugar. Following loading and sugar capture, the column is washed with 1.5 CV of water, then was eluted with 2.5 CV of 50% ethanol or 25% isopropanol (lower concentrations of ethanol at this step (25-30%) may be sufficient for product elution.) This solvent elution step released about 95% of the total bound sugars on the column and a small portion of color bodies (caramelized sugars). A volume of 2.5 L of ethanol or isopropanol eluate from the capture column was rotary-evaporated at 56° C. and a sugar syrup in water was generated. A column (GE Healthcare HiScale50/40, 5×40 cm, max pressure 20 bar) connected to a Biotage Isolera One FLASH Chromatography System was packed with 750 ml of a Darco Activated Carbon G60 (100-mesh): Celite 535 (coarse) 1:1 mixture (both column packings were obtained from Sigma). The column was equilibrated with 5 CV of water and loaded with sugar from step 3 (10-50 g, depending on the ratio of 2'-FL to contaminating lactose), using either a celite loading cartridge or direct injection. The column was connected to an evaporative light scattering (ELSD) detector to detect peaks of eluting sugars during the chromatography. A four-step gradient of isopropanol, ethanol or methanol was run in order to separate 2'-FL from monosaccharides (if present), lactose and color bodies. Fractions corresponding to sugar peaks were collected automatically in 120-ml bottles, pooled.

Figures 10A, 10B:
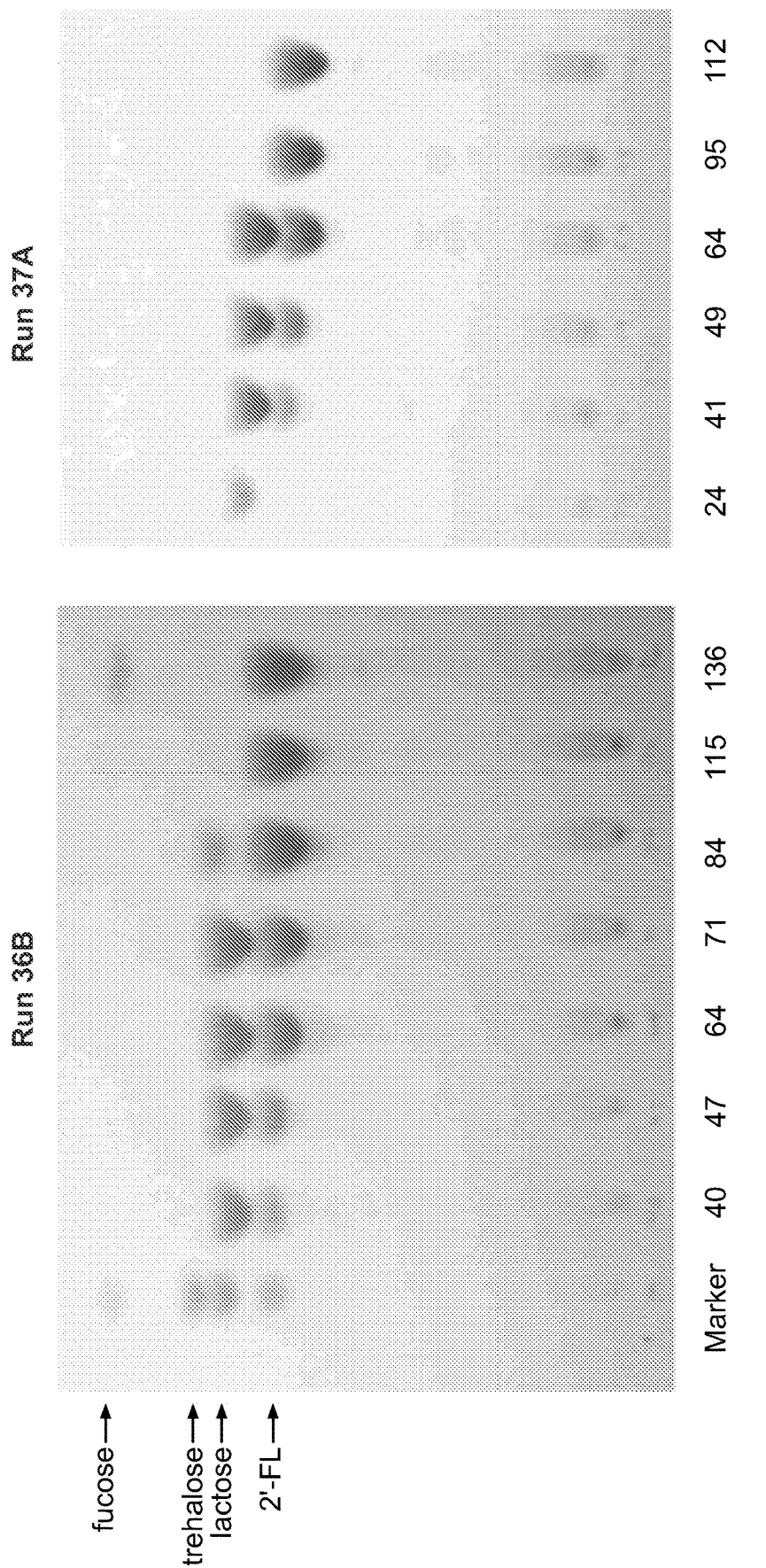
FIG. 10A and FIG. 10B are two photographs of thin layer chromatograms showing the fucosylated oligosaccharide products after two different 1.5 L fermentation runs from *E. coli* expressing FutN.

The results from two fermentation runs are shown in FIG. 10A and FIG. 10B. The cultures were grown for 136 (run 36B) or 112 hours (run 37A), and the levels of 2'-FL produced was analyzed by TLC analysis. As shown in both FIG. 10A and FIG. 10B, the 2'-fucosyllactose was produced at 40 hours of culture, and production continued to increase until the end point of the fermentation process. The yield of 2'-FL produced from run 36B was 33 grams per liter. The yield of 2'-FL produced from run 37A was 36.3 grams per liter. These results indicate that expression of exogenous FutN is suitable for high yield of 2'-fucosyllactose product.

TABLE 1

| Bacterium names | Accession No. | GI No. | Gene name [bacterium] | % identity FutC | Alias | SEQUENCE | SEQ ID NO |
|---|---|---|---|---|---|---|---|
| Helicobacter pylori | AAD29869.1 | 4808599 | alpha-1,2-fucosyl-transferase [Helicobacter pylori] | 98 | FutC | MAFKVVQICGGLGNQMFQYAFAKSLQKHSNTPVLLDITSEDWSDRKMQLELFPINLPYASAKEIAIAKMQH LPKLVRDALKCMGFDRVSQEIVFEYPELLKPSRLTYFYGYVFQDPRYFDAISPLIKQTFTLPPPPENNKNNNKKE EEYHRKLSLILLAAKNSVFVHIRRGDYVGIGCQLGIDYQKKALEYMAKRVPNMELFVFCEDLEFTQMLDLGYPF MDMITRNKEEEAYWDMLLMQSCQHGBANSTYSWWAAYLIENPEKIIGPKHWLFGHENILCKEWVKIESH FEVKSQKYNA | 1 |
| Helicobacter mustelae; Helicobacter mustelae 12198 | YP_003517185.1 | 291277413 | alpha-1,2-fucosyl-transferase [Helicobacter mustelae 12198] | 70.85 | FutL | MDFKIVQVHGGLGNQMFQYAFAKSLQTHLNIPVLLDTTWFDYGNRELGLHLFPIDLCICASAQQIAAAHMQ NLPRLVRGALRRMGLGRVSKEIVFEYMPELFEPSRIAYFHGYEQDPRYFEDISPLIKQTTLPHTEHAEQYSR KLSQILAAKNSVFVHIRRGDYMRLGWQLDISYQLRAIAYMAKRVQNLELFLECEDLEFVQNLDLGYPFVDMT TRDGAAHWDMLMQSCKHGIITNSTYSWWAAYLIKNPEKIIGPSHWIYGNENILCKDWKIESQPETKS | 2 |
| Bacteroides; Bacteroides vulgatus ATCC 8482; Bacteroides sp. 4_3_47FAA; Bacteroides sp. 3_1_40A; Bacteroides vulgatus PC510; Bacteroides vulgatus CL09T03C04; Bacteroides vulgatus dnLKV7; Bacteroides vulgatus CAG:6 | YP_001300461.1 | 150005717 | glycosyl transferase family protein [Bacteroides vulgatus ATCC 8482] | 24.83 | FutN | MRLIKVTGGLGNQMFIYAFYLRMKKYYPKVRIDLSDMMHYKVHYGYEMHRVFNLPHTEFCINQPLKKVIEFL FFKKIYERKQAPNSLRAFEKKYFWPLLYEKGFYQSERFFADIKDEVRESFTFDKNKANSRSLNMLEILDKDENA VSLHIRRGDVLQPKHWATTGSVCQLPYYCINAIAEMSRVASPSYYIFSDDIAWKENLPLQNAVYIDWNTD EDSWQDMMLMSHCKKHHIICNSTFSWWGAWLNPNIVIDKTVIVPSRWFIDHSEAPDIYPTGWIKPVS | 3 |
| Escherichia coli; Escherichia coli UMEA 3065-1 | WP_021554465.1 | 545259828 | protein [Escherichia coli] | 23.13 | WbgL | MSIIRLQGGLGNQLFQFSFGYALSKINGTPLYFDISHYAENDDHGGYRLNNLQIPEEYLQYYTPKINNIYKLLVR GSRLYFQDIFLELGFCNEFHAYGYDFEYIAQWKSKYLTGVVGSFHFHKHILDLKEFFIPKNVSEQANLLAAKIL ESQSSLSHIRRGDYIKNKTATLTHGVCSLEYYKALNKIRDLAMIRDVFIFSDDIFWCKENIETLLSKKYNIYYSE DLSQEEDLWLMSLANHHIIANSSFSWWGAYLGSSASQIVIYPTPWYDITPKNTYIPIVNHWINVDKHSSC | 4 |
| Helicobacter bilis; Helicobacter bilis ATCC 43879 | WP_005219731.1 | 491361813 | predicted protein [Helicobacter bilis] | 36.79 | FutD | MGDYKIVELTCGLGNQMFQYAFAKALQKHLQVPLLDKIWDTQDNSTQFSLDIENVDLEYATNTQIEKAK ARVSKLPGLLIIKMFGLKKHNIAYSQSFDFHDEYLLPNDFTYFSGFFQNAKYLKGLEQLEKSIFYDSNNESNEG KQRLELILQAKNSIFINIRRGDYCKIGWELGMDYYKRAIQVIMDRVEEPKPFIFGATDMSFTEQFQKNLGLNE NNSANLSEKTITQDNQHEDMFLIVICYCKHAILANSSYSEWSAYLNNDANNIVIAPTPWLLDNDNIICDDWIKI SSK | 5 |

TABLE 1-continued

| Bacterium names | Accession No. | GI No. | Gene name [bacterium] | % identity FutC | Alias | SEQUENCE | SEQ ID NO |
|---|---|---|---|---|---|---|---|
| Escherichia coli | AAO37698.1 | 37788088 | fucosyl-transferase [Escherichia coli] | 25.94 | Wbs.1 | MEVKIIGGLGNQMFQYATAFAIAKRTHQNLTVDISDAVKYKTHPLRLVELSCSSEEVKKAWPFEKYLFSEKIPH FMKKGMERKHYVEKSLEYDPDIDTKSINKKIVGYPQTEKYFKEFRHELIKEFQPKTKFNSYQNELLNLIKENDTC SLHIRRGDYVSSKIANETHGTCSEKYFERAIDYLMNKGVINKKTLLFIFSDDIKWCRENIFFNNQICFVQGDAY HVELDMLITVISKCKNNIISNSSFWWAAWLNENKNKTVIAPSKWEKKDIKHDIIPESWVKL | 6 |
| Vibrio cholerae | BAA33632.1 | 3721682 | probable beta-D-galactoside 2-alpha-L-fucosyl-transferase [Vibrio cholerae] | 25.94 | WbIA | MIVMKISGGLGNQLFQYAVGRAIAIQYGVPLKLDVSAYKNYKLHNGYRLDQFNINADIANEDEIFHLKGSSN RLSRIRRLGMLKKNTYYAEKQRTIVHVRRGDYLNHPEIGVLDIDYKRAVDYIKEKIEATVEFVFSNDVAWCKDNENFPIDSPVFIE HQIKIQQTHAVSIHVRRGDYLNHPEIGVLDIDYKRAVDYIKEKIEATVEFVFSNDVAWCKDNENFPIDSPVFIE DTQTEIDDLMLMCQCQHNIVANSSFSWWAAWLNSNVDKIVIAPKTWMAENPKGYKWVPDSWREI | 7 |
| Bacteroides fragilis; Bacteroides fragilis NCTC 9343; Bacteroides fragilis YCH46; Bacteroides fragilis HMW 615 | YP_099118.1 | 53713126 | alpha-1,2-fucosyl-transferase [Bacteroides fragilis YCH46] | 24.58 | Bft2 | MIVSSLRGGLGNQMFIYAMVKAMALRNNVPFAFNETTDEANDEVYKRKLLLSYFALDLPENKKLLTFDFSYGN YYRRLSRNLGCHILHPSYRYICEERPPHEESRLISSKITNAFLEGYWQSEKYFLDYKQEIKEDPVIQKKLEYTSYLE LEEIKLLDKNAIMIGVRRYQESDVAPGGVLEDDYYKCAMDIMASKVTSPVFFCFSQDLEWVEKHLAGKYPVR LISKKEDDSGTIDDMELMMHERNYIISNSSFYWWGAWLSKYDDKLVIAPGNFINKDSVPESWFKLNVR | 8 |
| Escherichia coli; Escherichia coli KTE84 | WP_001592236.1 | 486356116 | protein [Escherichia coli] | 24.25 | WbgN | MSIVVARLAGGLGNQMFQYAKGYAESVERNSYLKLDLRGYKNYTLHGGFRLDKLNIDNTFVMSKKEMCIFP NFIVRAINKPFKLSLCSKRFESEQYSEKKINGSMKGSVEFIGEWQNERYFLEHKEKLREIFTPININLDAKELSDVI RCTNSVSVHIRRGDYVSNVEALKIHGLCTERYYIDSIRYLKERFMNLVFFVESDDIEWCKKYKNELESRSDDVKFI EGNTQEVDMWLMSNAKYHIIANSSFSWWGAWLKNYDLGIITIAPTPWEERERELNSFDPCPEKWVRIEK | 9 |
| Prevotella melaninogenica; Prevotella melaninogenica ATCC 25845 | YP_003814512.1 | 302346214 | glycosyl-transferase family 11 [Prevotella melaninogenica ATCC 25845] | 31.1 | FutO | MKIVKILGGLGNQMFQYALYLSLQESFPKKERVALDLSSFHGYHLHNGFELENIFSVTAQKASAADIMRIAYYY PNYLLWRIGKRFLPRRKGMCLESSSLREDESVLRQEGNRYPDGYVVQDERYFAAYREKVLKAFTEPAFKRAEN LSLLEKLDENSIALHVRRGDYVGNNLYQGICDLDYYRTAIEKMCAHVTPSLFCIFSNDITWCQQHLQPYLKAP VVYVTWNTGVESYRDMQLMSCCAHNIIANSSFSWWGAWLNQNREKVVIAPKKWLNMEECHFTLPASWI KI | 10 |
| Clostridium bolteae; Clostridium bolteae 90A9; Clostridium bolteae 90133; Clostridium bolteae 90B8 | WP_002570768.1 | 488634090 | protein [Clostridium bolteae] | 29.86 | FutP | MFQYALYKAFEQKHIDVYADLAWYKNKSVKFELYNFGIKINVASEKDINRLSDCQADEVSRIRRKIEGKKKSEV SEKNDSCYENDILRMDNVYLSGYWQTEKYFSNTREKLLEDYSFALVNSQVSEWEDSIRNKNSVSIHIRRGDYL QGELYGGICTSLYYAEAIEYIKNARVPNAKPFVFSDDVEWVKQQEDFKGFVIVDRNEYSSALSDMYLMSLCKH NIIANSSFSWWAAWLRNEEEKIVIAPRRWLNGKCTPDIWCKKWIRI | 11 |

TABLE 1-continued

| Bacterium names | Accession No. | GI No. | Gene name | % identity FutC | Alias | SEQUENCE | SEQ ID NO |
|---|---|---|---|---|---|---|---|
| Lachnospiraceae bacterium 3_1_57FAA_CT1 | WP_009251343.1 | 496545268 | protein [Lachnospiraceae bacterium 3_1_57FAA_CT1] | 29.25 | FutQ | MVIVQLSGGLGNQMFEYALYLSLKAKGKEVKIDDVTCYEGPTRPQLDVEGITYDRASREELTEMTDASM DALSRVRRKLTGRRTKAYRERDINFDPLVMEKDPALLEGCFQSDKYFRDCEGRVREAYRERGIESGAFPLPED YLRLEKQIEDCQSVSVHIRRGDYLDSHGGLYTGICTEAYYKEAFARMERLVPGARFFLFSNDPEVTREHFES KNCVLVEGSTEDTGYMDLYLMSRCRHNIIANSSFSWWGAWLNENPEKKVIAPAKWLNGRECRDIYTERMI RL | 12 |
| Methanosphaerula palustris; Methanosphaerula palustris E1-9c | YP_002467213.1 | 219852781 | glycosyl transferase family protein [Methanosphaerula palustris E1-9c] | 28.52 | FutR | MIIVRLKGGLGNQLSQYALGRKIAHLHNTELKLDTTWFTTISSDTPRTYRLNNYNIIGTIASAKEIGLIERGRAQ GRGYLLSKISDLLTPMYRRTYVRERMHTFDKAILTVPDNVYLDGYWQTEKYFKDIEEILRREVTLKDEPDSINLE MAERIQACHSVSLHVRRGDYVSNPTTQQFHGCCSIDYYNRAISLIEEKVDDPSFFIFSDDLPWAKENLDIPGE KTFVAHNGPEKEYCDLWLMSLCQHHIIANSSFSWWGAWLGQDAEKMVIAPRRWALSESFDTSDIIPDSWI TI | 13 |
| Tannerella sp. CAG:118 | WP_021929367.1 | 547187521 | glycosyl transferase family 11 [Tannerella sp. CAG:118] | 28.38 | FutS | MVRIVEIIGGLGNQMFWQYAPSLYLKNKSHIWDRLYVDIEAMKTYDRHGLELEKVFNLSLCPISNRLHRNLQK RSFAKHFVKSLYEHSECEFDEPVYRGLRPIYRYRGYWQNEGYFVDIEMIREAFQNFVNILSKKTKAIASKMR RELSVSIHVRRGDYENLPEAKAMHGGICSLDYYHGKAIDFIRQRLDNNICFYLFSDDINMVEENLQLENRCIID WNQGESDSWQDMYLMSCCRHHIIANSSFSWWAAWLNPNKWFNHTDAVGIVPGSWIKIPVF | 14 |
| Bacteroides caccae; Bacteroides caccae ATCC 43185 | WP_005675707.1 | 491925845 | protein [Bacteroides caccae] | 28.09 | FutU | MKIVKILGGLGNQMFQYALFLSLKERFPHEQVMIDTSCFRNYPLHNGFEVDRIFAQKAPVASWRNILKVAYP YPNYRFWKIGKYILPKRKTMCVERKNPSFDAAVLTRKGDCYDGYWQHEEYFCDMKETIWEARSFPEPVDG RNKEIGALLQASDSASLHVRRGDYVNHPLFRGICDLDYYKRAIHYMEERVNPQLYCFSNDMAWCESHLRA LLPGKEVVYVDWNKGAESYVDMRLMSLCRHNIIANSSFSWWGAWLNRNPQKVVAPERWMNSPIEDPV SDKWIKL | 15 |
| Butyrivibrio sp. AE2015 | WP_022772718.1 | 551028636 | protein [Butyrivibrio sp. AE2015] | 27.8 | FutV | VIIQLKGGLGNQMFQYALKSLKKRGEKVKIDDKTGFVNDKLRIPVLSRWGVEYDRATDEEIINLTDSKMDL FSRIRRKLTGRKTFRIDEESGKFNPELEKENAYLVGYWQCDKYFDDKDVVREIREAFEKKPQELMTDASSWS TLQQIECCESVSLHVRRTDVDEEHIHIHNICTEDYYKNAIDRVKQYPSAVFFITDDKEWCRDHFKGPNFIV VELEEGDGTDIAEMTLMSRCKHHIIANSSFSWWAAWLNDSPEKIVIAPQKWINNRDMDDIYTERMTKIAL | 16 |
| Prevotella sp. CAG:891 | WP_022481266.1 | 548264264 | uncharacterized protein [Prevotella sp. CAG:891] | 27.4 | FutW | MRLIVKMIGGLGNQMFIYAFYLQMRKRFSNVRIDLDMMHYNVHYGYELHKVFGLPRTEFCMNQPLKKVL EFLFRTIVERKQHGRMEPYTCQVYWPLVYFKGFYQSERYFSEVKDEVRECFTFNPALANRSSQQMMEQIQ NDPQAVSIHIRRGDYLNPKHYDTIGCICQLPYYKHAVSEIKKYVSNPHFYVFSEDLDWVKANLPLENAQYIDW NKGADSWQDMMLMSCCKHHIICNSTFSWWAAWLNPSVEKTVIMPEQMTSRQDSVDFVASCGRWVRV KTE | 17 |
| Parabacteroides johnsonii; Parabacteroides johnsonii CL02T1C29 | WP_008155883.1 | 495431188 | glycosol transferase [Parabacteroides johnsonii] | 26.69 | FutX | MRLLIKMIGGLGNQMFIYAFYLKMKHHYPDTNIDLSMNVHYKVHNGYEMNRIFDLSQTEFCINRTLKKILEFL FFKKIYERRQDPSTLYPYEKRYFWPLLYFKGFYQSERFFFDIKDDVRKAFSFNLNIANPESELLKQIEVDDQAV SIHIRRGDYLLPRHWANTGSVCQLPYYKNAIAEMENRITGPSYYVFSDDISWVKENIPLKKAVYVTWNKGED SWQDMMLSHCRHHIICNSTFSWWGAWLNPREKIVIAPCRWFQHKEPPDMYPKEWIKVPIN | 18 |

TABLE 1-continued

| Bacterium names | Accession No. | GI No. | Gene name [bacterium] | % identity FutC | Alias | SEQUENCE | SEQ ID NO |
|---|---|---|---|---|---|---|---|
| Akkermansia muciniphila; Akkermansia muciniphila ATCC BAA-835 | YP_001877555.1 | 187735443 | glycosyl transferase family protein [Akkermansia muciniphila ATCC BAA-835] | 25.67 | FutY | MRLFGGLGNQLFQYAFLFALSRQGGKARLETSSYEHDDKRVCELHHFRVSLPIEGGPPPWAFRKSRIPACLRS LFAAPKYPHFREEKRHGFDPGLAAPPRRHTYFKGYFQTEQYFLHCREQLCREFRLKTPLTPENARILEDIRSCCS ISLHIRRTDYLSNPYLSPPPLEYYLRSMAEMEGRLAAGAPQESLRYFIFSDDIEWARQNLRPALPHVHVDIND GGTGYFDLELMRNCRHHIIANSTFSWWAAWLNEHAEKIVIAPRIWFNREEGDRYHTDDALIPGSWLRI | 19 |
| Salmonella enterica; Salmonella enterica subsp. enterica serovar Poona str. ATCC BAA-1673 | WP_023214330.1 | 555221695 | fucosyl-transferase [Salmonella enterica] | 25.99 | FutZ | MYSCLSGGLGNQMFQYAAAYILKQYFQSTTLVLDDSYYSQPKRDTVRSLELNQNFNISYDRFSFADEKEKIKLL RKFKRNPFPKQISELLSIALFGKYALSDRAFYTFETIKNIDKACLFSFYQDADLLNKYKQLILPLFELRDDLLDICKN LELYSILQRSNNTTALHIRRGDYVTNQHAAKYHGVLDISYYNHAMEYVERERFKQNFIIFSDDVRWAQKAPL ENDNCYVINNSDYDFSAIDMYLMSLCKNNIIANSTYSWWGAWLNKYEDKLVISPKQWFLGNNETSLRNAS WITL | 20 |
| Bacteroides sp. CAG:633 | WP_022161880.1 | 547748823 | glycosyl-transferase family 11 [Bacteroides sp. CAG:633] | 26.01 | FutZA | MRLIKMTGGLGNQMFIYAFYLRMKKRYPKVRIDLSDMNHYHVHHGYEMHRVFNLPHYEFCINQPLKKVIEF LFFKKIYERKQDPNSLRAFEDDYLWPLLFKGFYQSERFFADIKDEVRKAFTFDSSVKVARSAELLRRLDADAN AVSLHIRRDGYIQPQHWATTGSVCQLPYYQNAIAEMNRRVAASPYVVFSDDIAWVKENIPLQNAVVIDWN KGEESWQDMMLMSHCRHHIICNSTFSWWGAWLDPHEDKIVIVPNRWFQHCETPNIYPAGWVKVAIN | 21 |
| Clostridium sp. CAG:306 | WP_022247142.1 | 547839506 | alpha-1-2-fucosyl-transferase [Clostridium sp. CAG:306] | 34.28 | | MEKIKIVKLQGGMGMGNQMFQYAFGKGLESKFGCKVLFDKINVDELQKTIINNTGKNAEGICVRKYELGIFNLNI DFATAEQIQECIGEKLNKACYLPGFIRKIFNLSKNKTVSNRIFEKKYGEYDEEILKDYSLAYYDGYFQNPKYFEDI SDKIKKEFTLPEIKNHDIYNKKLLEKITQFENSVFIHVRRDDYLNINCEIDLDYQKAVKYILKHIENPKFPVCAE DPDYIKNHFDIGYDFELVGENNKTQDTYYENMRLMMACKHAIIANSSYSWWAAWLSYDNKIVIAPTPWL PGISNEIICKNWIQIRGISNE | 22 |
| Prevotella sp. oral taxon 306; Prevotella sp. oral taxon 306 str. F0472 | WP_009434595.1 | 497004957 | protein [Prevotella sp. oral taxon 306] | 32.11 | | MKIVKLIGGGLGNQMPQYALYLSLQESFPKERVALDLSCFNGYHLHNGFELERIFSLTAQKASAATIMRIAYYP NYLLWRIGKRLLPRRKTMCLESSTFRYDESVLTREGNRFYPDGVWQDERYFVACREKVLKAFTPPAFKRTENLS LLRKLDKNSVAIHVRRGDYIGNQLYOGICDLDYYRAAIDKISTYVTPSVFCIFSNDIAWCQTHLQPYLKAPVVY VTWNTGTESYRDMQLMSCCAHNIIANSSFSWWGAWLNQNNEKVVIAKRWLNMDDCQFPLPASWKI | 23 |
| Brachyspira sp. CAG:484 | WP_021917109.1 | 547133308 | glycosyl transferase family 11 [Brachyspira sp. CAG:484] | 30.14 | | MQLIVKLMGGLGNQMFQYAFAKALGDKNILFYDGYKKHSLRKVELNRFKCKAVYIPRELFKYLKFVTKFDKIE YMRSDIYVPEYLNRDGNHIYIGFWQTEKYFKQIRPRLLKDFTPRKKLDRENAGIISKMQQINSVSVHIRRTDYV DESHIYDGTNLDYYKRAIEYSSKIENPEPFFFSDDMAYVKEKFAGLKFPHSFIDINSGNNSYKDLILMKNCKHN IIANSTFSWWGAWLNENENEEKIVIAPAKWFVTGENKDKIVPDEWIKL | 24 |
| Thalassospira profundimaris; Thalassospira profundimaris WP0211 | WP_008889330.1 | 496164823 | glycosyl transferase family 11 [Thalassospira profundimaris] | 30. | | MVIVKLLGGLGNQMFQYATGRAVASRLDVELLLDVSAFAHYDLRRYELDDWNITARLATSEELARSGVTAA PPSFFDRIAFLRIDLPVNCFREASFYDPRILEVSSPVYLLDGYWQSERYFLDIEKKLRQEFQLKASIDANNHSFK KKIDGLGKQAVSLHVRRGDYDVTNPQTASYHGVCSLDYYRAAVDYIAEHVSDPCFFVFSDDLEWVQTNLNIK QPIVLVDANGPDNGAADMALMMACRHHIIANSSFSWWGSWLNPLNDKIIVAPKKWFGRANHDTTDLVP DSWRL | 25 |

TABLE 1-continued

| Bacterium names | Accession No. | GI No. | Gene name [bacterium] | % identity FutC | Alias | SEQUENCE | SEQ ID NO |
|---|---|---|---|---|---|---|---|
| Acetobacter sp. CAG:267 | WP_022078656.1 | 547459369 | alpha-1 2-fucosyl-transferase [Acetobacter sp. CAG:267] | 29.99 | | MAVSPQESKYSAHVSPDKPLRIVRLGGGLGNQMFQYAFGLAAGDVLMDNTSFLITNHYRSFDLGLYNISGDF ASNEQIKKCKNEIRFKNILPRSIRKKPNLGKFIYLKTNRVCERQINRYEPELLSKDGDVYYDGVFQTEKYFKPLRE RLLHDFTLTKPLDAANLDMLAKIRAADAVAVHIRRGDYLNPRSPFTYLDKDYFLNAMDYIGKRVDKPHFFIFS SDTDWVRTNIQTAYPQTIVEINDEKHGYFDLELMRNCRHNIIANSTFSWWGAWLNTNPDKIVVAPKQWFR PDAAEYSGDIVPNKDWIKL | 26 |
| Dysgonomonas mossii; Dysgonomonas mossii DSM 22836 | WP_006842165.1 | 493896281 | protein [Dysgonomonas mossii] | 29.9 | | MVTVLLSGGLGNQMFQYAAAKSLAIRLNTALSVDLYTFSKKTQATVRPYELGIGNIEDVVETSSLKAKAVIKAR PFIQRHRSFFQRFGVFTDTYAILYQPTFEALTFFVIMSGYFQNESYFKNISELLRKDFSFKYPLIGENKDVAGQI SENQSVAVHIRRGDYLNKNSQSNFAILEKDYYEKAINYISAHVKNPEFYVFSEDFDWIKDNLNFKEFPVTFID WNKGKDSYIDMQLMSLCKHNIIANSSFSWWSAWLNNSEERKIVAPERWFVDEQKNELLDCFYPQGWIKI | 27 |
| Clostridium sp. KLE 1755 | WP_021636924.1 | 545396671 | glycosyl-transferase, family 11 [Clostridium sp. KLE 1755] | 29.83 | | >gi|545396671|ref|WP_021636924.1|glycoyltransferase, family 11 [Clostridium sp. KLE 1755]MIEISGGLGNQMFQYALGQKFISMGKEVKYDLSFYNDRVQTLRQFELDIFDLDCPVASNSELS GNSLSRLKQKLGWDKEKIYEENLDLGYQPRIFELDDIYSGYWQDSELYFKDIREQILRLYTFPIQLDYMNGVFL RKIENSNSVSIHIRRGDYLNENNLKIYGNICTLNYYNKALQIIAKKITNPIIFVFTNDIEWVRKELEIPNMVIVDC NSGKLSYWDMYLMSKCCKANIVANSSFSWWGAWLNKNENRIIISPKRWLNNHEQTSTLCDNWIRCGDD | 28 |
| Gillisia limnaea; Gillisia limnaea DSM 15749 | WP_006988068.1 | 494045950 | alpha-1,2-fucosyl-transferase [Gillisia limnaea] | 29.28 | | MFISKNTVIIKLVGGLGNQMFQFAIAKIIAEKEKESEVLVDITFYTELTENTKKFPRHFSLGIFNSSFAIASKKEIDYF TKLSNFNKFKKKLGLNYPTIPHESSENFKAQVLELKAPIYLNGYFQSFRYFLGKEYVIRKIFKFPDEALDKDNDNI KRKIIGKTSVSLHIRRGDYVNNKKTQQFHGNCTIDYYQSAIAYLSSKLTDFNLIFFSDDIHWRVQQFKNISNQKI YVSGNLNHNSWKDMYLMSLCDHNIIANSSFSWWGAWLNKNPEKIIIAPKWFADITEQDKNSIDLIPSEWY RI | 29 |
| Methylotenera mobilis; Methylotenera mobilis JLW8 | YP_003048467.1 | 253996403 | glycosyl transferase family protein [Methylotenera mobilis JLW8] | 29.19 | | MLVSRIIGGLGNQMFEYAAARAASLRISVQLKLDLSGFETYDLHAYGLNNFNIVEDVAKKDDYFIGAPESLLKK IKKYLRGLIQLESFRESDLSFDSKVLELNDNTYLDGYWQCERYFIDFDKQIRQDFSFKFAPDALNQRYLELIDSV NAVSVHIRRGDYVSNSTTNEIHGVCDLDYYQRAAEFMRARIGPENLHFFVFSDDTDWKENISFGSDTTFIS HNDAAKNYEDMRLMSACKHHIIANSSFSWWAAWLNPSKQKVVIAPRQWFKSTLLNSDDIVPASWVRL | 30 |
| Runella slithyformis; Runella slithyformis DSM 19594 | YP_004658567.1 | 338214504 | glycosyl transferase family protein [Runella slithyformis DSM 19594] | 29.14 | | WMMVKLSGGLGNQLFQYAFGRHLATVNQKELKLDTSALTKTSDWTNRSYALDAFNIRAQATPEIKALAGKP NRLLQRVGRKVGITPIQYFQEPHFFYSSALSIKSSHYLEGYWQSEKYFEAITPIILREEFAFTISPSTHAQTIEKEKI SNGTSVSIHLRRGDYVKTSKANRYLRPLTMDYYQKAIDYINQRVKNPNFFLFSDDIKWAKSQVTPPTTHFST GTSAHEDLWLMTHCRHHIIANSTFSWWGAWLNQQPDKIVIAPQKWFSTERPDTKDLLPEPWIQL | 31 |
| Pseudo-alteromonas haloplanktis; Pseudo-alteromonas haloplanktis ANT/505 | WP_002958454.1 | 489048235 | alpha-1,2-fucosyl-transferase [Pseudo-alteromonas haloplanktis] | 29.1 | | MIKVKAIGGLGNQLFQYATARAIAEKRGDGNNNDMSDFSSYKTHPFCLNKFPRCKATYESKPKLINKLLSNEIKR NLLQKLGFIKKYFETQLPFNEDVLLNNSINVLTGYFQSEKYFLSIRECLLDELITLEDLNIAETAVSKAIKNAKNSI SIHIRRGDYVSNEGANKTHGVCDSDYFKKALNYFSERKLLDEHTELFIFSDDIEWCRNNLSFDYKMNFVDGSS ERPEVDMVLMSQCKHQVISNSTFSWWGAWLNKDEKVVAPKEWFKSTDLDSTDIVPNQWIKL | 32 |

TABLE 1-continued

| Bacterium names | Accession No. | GI No. | Gene name | % identity FutC | Alias | SEQUENCE | SEQ ID NO |
|---|---|---|---|---|---|---|---|
| uncultured bacterium | EKE06679.1 | 406985989 | glycosyl transferase family 11 [uncultured bacterium] | 28.67 | | MLTLKLKGGLGNQMFQYAAASHNLAKNKKTKINFDLSFFSDIEVRDIKRDYLLDKFNISADISFDQKNISGPRK FLVKVISKFPGEVYFYRLKFLSSKYLDGYFQSEKYFKNVEEDIRKDFTLDKDEMGVEAKKIEQQIVNSKNSVLHIR RGDYVDDLKTNIYHGVCNLDYYKRSIKYLKENFGEINIFVFSDDIAWVKENLAFENLQFVSRPDIKDYEEMI MSKCEHNIIANSSFSWWGAWLNENKNKIIIAPKEWFQKFNINEKHIVPKSWIRL | 33 |
| Clostridium sp. KLE 1755 | WP_021636949.1 | 545396696 | glycolsyl-transferase, family 11 [Clostridium sp. KLE 1755] | 28.57 | | MIVQLSGGLGNQMFEYALYLSLKAGKVVKIDDITCYEGPGTRPKQLDVFGVSYERATKQELTEMTDSSLD PVSRIRRKLTGRKTKAYREKDINFDPQNMERDPALLEGCFQSEKYFQDCREQVREAYRRGIESGAYPLPEAY RRLEKEIADCKSVSVHIRRDGYLEESHGGLYTGICTEQYYQEAFARMEKVPGAKPFLFSNDPDWTREHPKGE NRILVEGSTEDTGYLDLYLMSKCCKHNIIANSSFSWWGAWLNDNPEKKVTAPWLNGRECRDIYTERMIRI | 34 |
| Francisella philomiragia; Francisella philomiragia subsp. philomiragia ATCC 25015 | WP_004287502.1 | 490414974 | alpha-1,2-fucosyl-transferase [Francisella philomiragia] | 28.57 | | MKIIIKIQGGLGNQMPQYAFY TABLE 1-continued

| Bacterium names | Accession No. | GI No. | Gene name [bacterium] | Alias | % identity FutC | SEQUENCE | SEQ ID NO |
|---|---|---|---|---|---|---|---|
| Polaribacter sp. MED152 | WP_07670847.1 | 472321325 | glycosyl transferase family 11 [Polarbacter sp. MED152] | | 28.42 | MVVRILGGLGNQMFQYAYAKSLAEBKGYEVQIDISKFKSYKLHGGYHLDKFRIDLETANSSSAFLSKIGLKKTIK EPNLLFHKDLLKVNNNAFIKGYFQAEQYFSDIREILINQFKIKKELAKSTLAIKNQIELLKTTCSHLVRRDGYISDK KANKVHGTCDLDYYSSAIEDHISKQNSNVHFFVFSDDIAWVKDNLNITNARYDHNVIPHEDMYLMTLCNHNI TANSSFSWWGAWLNQNPDKIVIPKNWFVDKENEVACKSWITL | 41 |
| Mehtanococcus maripaludis; Methanococcus maripaludis C7 | YP_001329558.1 | 150402264 | glycosyl transferase family protein [Methanococcus maripaludis C7] | | 28.19 | MKIIQLKGGLGNQMFQYALYKLKKRGQEVLLDISWYLKNNAHNGYELEWFGLSPEYASIRQCFKLGDIPI NLIYNVKRKVFPKKTHFFEKSNFNYDNNVFEVTNGYFEGWQNENYFKNFRSEILNDFSFKNIDKRNAEFSEY LKSINSVSVHVRRGDYVTNQKALNVHGNICNLEYYNKAINLANNNLKNPKFVIFSDDITWCKSNLGIDDPYYV DWNTGPYSYQDMYLMSNCKKNIIANSSFSWWGAWLNQNTEKKVFSPKKWVNDRNNVNIVPNGWIKIK | 42 |
| Gallionella sp. SCGC AAA018-N21 | WP_018293379.1 | 517104561 | protein [Gallionella sp. SCGC AAA018-N21] | | 28.15 | MIIAHIIGGLGNQMFQYAAGRALSLARGVPFKLDISGFEGYDLHQGFELQRVFNCAAGIASEAEVRDSLGW QFSSPIRRIVARPSLAVLRRSTFVVEPHFHYWAGIKQVPDNCYLAGYWQSEQFQSHAAVIRTDFAPKPPLSG QNSKLAMQIAQGNAVSLHIRRGDYANNPKTTATHGLCSLDYYRAAIQHIAERVQSPHFFIFSDDIAWKSNL AINFPHQVYGHNQGTESYNDMRLMSLCQHNIIANSSFSWWGAWLNTNAHKIVIAPKQWFANTTHVADLI | 43 |
| Azospira oryzae; Dechlorosoma suillum PS | YP_005026324.1 | 372486759 | Glycosyl transferase family 11 [Dechlorosoma suillum PS] | | 28.04 | MQSPACIAGARAWWVGYGMABAMQPVVVGLSGGLGNQMFQYAAGRALAHRLGHPLSLDLSWFQGRG DRHFALAPFHIAASLERAWPRLPPAMQAQLSRLSRRWAPRIMGAPVFREPHFGYVPAGAALAAPVFLEGY WQSERYVFRELREPLLQDFSLRQPPLPASCQPILAAIGNSDAICVHVRRGDYLSNPVAAKVHGVCPVDYYQQGV AELSASLARPHCFVFSDDPEWVRGSLAFPCPMTVDVNGPAEAHFDLALMAACQHFVIANSSLSWWGAW LGQAAGKRVIAPSRWFLTSDKDARDLLPPSWERR | 44 |
| Prevotella paludivivens | WP_018463017.1 | 517274199 | protein [Prevotella paludivivens] | | 28 | MKIVKIIGGLGNQMFQYADRRHMISEDTSFKIMPEVITSHNYKYYDGYWQHEEYFKNIHDEILDAFKPFQDER NKALAERLSDSNSISIHIRRGDYLNDELFKGTCGIEYYKKAIEEINERTVFLFCVFSNDIHWCKENIEPLLNGKE TIYVDWNTGSDNYRDMQLMTKCKHNIIANSSFSWWGAWLNNTKDKIVIAPRIWYNTKEKVSPVASSWIKL | 45 |
| Gramella forsetii; Gramella forsetii KT0803 | YP_860609.1 | 120434923 | alpha-1,2-fucosyltransferase [Gramella forsetii KT0803] | | 27.96 | MSNKNPVIVEIMGGLGNQMFQFAVAKLLAEKNSSVLLVDTNFYKEISQNLKDFPRYFSLGLIFDISYKMGTEN GMVNFKNSLFKNRVSRKLGLNYPKIFKEKSYRFADLFNKKTPIYLKGYFQSYKFIGVESKIRQWFRPYENL GVGNEEIKSKILEKTSVSVHIRRGDYVENKKTKEFHGNCSLEYYKNAITYPLDIVKEFNIVFFSDDISWVRDEFK DLPNEKVFVTGNLHENSWKDMYLMSLCDHNIIANSFSWWAAWLNNNSEKNVIAPKKWFADIDQEQKSL DLLPSWIRM | 46 |
| Mariprofundus ferrooxydans; Mariprofundus ferrooxydans PV-1 | WP_009849029.1 | 497634831 | alpha-1,2-fucosyltransferase [Mariprofundus ferrooxydans] | | 27.92 | MIIVQFTGGLGNQMFQYALGRRLSLLHDVELKFDLSFYQHDILRDFMLDRFQVNGQVATEKEIEAYTNTPIF ALDRPLLDRLVRWGLYRGIVSVSDEPPGKQALMNYNSRVLQAPRNTYVQGYWQSEKYFMPIRQKLLDDFSL VDKADQANGAMLEKIRQCHSVSLHVRRGDVVSNPLTNHSGTCGLEYYEKAIALIGSKVDDPHFFVFSDDPE WTRDHLKCRFPMTVTCNSADSCEWDMELMRHCRDHIIANSFSWWGAWLNMNPDKVVAPAAWFN NFSADTSDLIPDSWVRI | 47 |
| Bacillus cereus; Bacillus cereus VD107 | WP_002174293.1 | 488102896 | protein [Bacillus cereus] | | 27.91 | MKIIQVSSGLGNQMFQYALYKKISLNDNDVFLDSSTSYMYKNQHNGYELERIFHIKPRHAGKEIIKNLSDLD SELISRIRRKLFGAAKKSMYVELKEFEYDPIIFEKKETYFKGYWQNTNYFKDIEQELRKDFVFTEKLDKRNEKLANE IRNKNSVSIHIRRGDYYLNKYEEKFGNIANLEYYLKAINLVKKIEDPKFYFSDDIDWAQKNINLTNDVVYISH NQGNESYKDMQLMSLCKHNIIANSTFSWWGAFLNNNDDKIVVAPKKWINIKGLEKVELFPENWITY | 48 |

TABLE 1-continued

| Bacterium names | Accession No. | GI No. | Gene name | % identity FutC | Alias | SEQUENCE | SEQ ID NO |
|---|---|---|---|---|---|---|---|
| Firmicutes bacterium CAG:534 | WP_022352106.1 | 547951299 | protein [Firmicutes bacterium] | 27.81 | | MIIIRMTGGLGNQMFQYALYLKLRAMGKEVKMDDFTEYEGREARPLSLWAFGIEYDRASREELCRMTDGFL DPVSRIRRKLFGRKSLEYMEKDCNFDPEILNRDPAYLTGYFQSEKYFADIEEEVRQAFRFSERIWEGIPSQLLER IRSYEQGIKTMAVSVHIRRGDYLQNEEAYGGICTERYYKTAIEYVKKRQQDASFVFTNDPDYAGEWILKNF GQEKERFVLIEFTQEENGYLDLYLMSLCRHHILANSSFSWWGAYLNPSREKMVIVPHKWFGNQECRDIYME NMIRIAKEQS | 49 |
| Sideroxydans lithotrophicus; Sideroxydans lithotrophicus ES-1 | YP_003525501.1 | 291615344 | glycosyl transferase family 11 [Sideroxydans lithotrophicus ES-1] | 27.81 | | MVISNIIGGLGNQMFQYAAARALSLKLEVPLKLDISGFTNYALHQGFELDFRIGCKIEIASEADVHEILGWQSA SGIRRVVSRPGMSIFRRKGFVVEPHFSYWNGIRKITGDCYLAGYWQSEKYFLDAAVEIRKDFSFKLPLDSHNA ELAEKIDQENAVSLHIRRGDYANNPLTAATHGLCSLDYYRKSIKHIAGQVRNPYFFVFSDDIAWVKDNLEIEFP SQYVDYINHGSMSFNDMRLMSLCKHHIIANSSFSWWGAWLNPNPEKVVIAPERWFANRTDVQDLLPPGW VKL | 50 |
| zeta proteobacterium SCGC AB-137-C09 | WP_018281578.1 | 517092760 | protein [zeta proteobacterium SCGC AB-137-C09] | 27.81 | | MIVSQIIGGLGNQMFQYATGRALSHRLHDTFFLDLDGFSGYQLHQGFELSNVFQCEVNVATRSQMQALLG WRSFSSVVRRLLMKRSLKWARGHRVMIEPHFHYWSRFAEINEGCYLSGYWQSERYFKPIENIIRQDFKFNHLL KGVNLDLAAQOMETVNSNSLHVRRGDYASDANTNHTHGLCPLDYYRDAILYIAQNTVAPSFFIFSDDIEWCRE HLKLSFPATYIDHNKGSNSYCDMQLMSLCHHHIIANSSFSWWGAWLNTRLDKVIAPKQWFANGNRTDDLI PAEWLVM | 51 |
| Pedobacter heparinus; Pedobacter heparinus DSM 2366 | YP_003090434.1 | 255530062 | glycosyl transferase family protein [Pedobacter heparinus DSM 2366] | 27.8 | | MKIIRFPLGGLGNQMFQYAFYKSLQHRFPPHVKADLQGYQEYTLHNGFELEHIFNIKVNSVSSFTSDLFYNKKW LYRKLRRILNKLRNTYIEEKKLFSPDSLLNNPKSAYYWGYWQNFQYFEHIADDLRKDFQFRAPLSAQNQEVLD QTKLSNSISLHIRRGDYIKDPLLGGLCGPEYYQTAINYIITSKVNAARFFIFSDDIDWCIANLKLQDCSFISWNKG TSSYIDMQLMSSCKHHIVANSSFSWWAWLNPNPDKIVIAPEKWTNDKDINVRMSPPQGWISL | 52 |
| Methylophilus methylotrophus | WP_018985060.1 | 517814852 | protein [Methylophilus methylotrophus] | 27.78 | | MFQYAMGLSLAARNNQTPLKLDLSQFTDYKLHNGFELSKVFNCSAETASVTQIETLLGICKYSFIRRILKNTYLKN LRPAQYVVEPFFGYMDGVNFLGDNVVLEGYWQSOKYFIDYESTIRTHFTFKNILSGENLKLSDRIKGSNSVSL HIRRGDYVTNKNNAFIGTCSLLIYYQNAIEYFSTKIADPIFFISDDITWAKSNLRLANEHYFVGHNQGEDSHFD MQLMSLCKHHIIANSSFSWWGAWLNPSKDKIIIAPKKWFASGLNDQDLVPKDWLRI | 53 |
| Rhodobacterales bacterium HTCC2255 | WP_008033953.1 | 495309205 | alpha-1,2-fucosyltransferase [Rhodobacterales bacterium HTCC2255] | 27.7 | | MIYTRIRGGLGNQLFQYSAARSLADYLNVSLGLDTREFDENSPYKMSLNHGNIRADLNPPDLIKHKKDGKIAYI IDHIKGNQKVYKEPPLSFDNLFSNVDGYTYLKGYWQSEKYFLRNRKNILSDINLIKKTDKFNTINLKEIKKSTSI SLHIRRGDYILSNESYNETHGICSLSYYTDAVEYIKNRLGENIKVFAPSDDPDWLENLKLSVDIKIINNNTSANS FEDLRLMLNCDHNIIANSSFSWWGAWLNQNPEKIVISPKKWVNKKQLQNADIVPSSWLKV | 54 |
| Spirulina subsalsa | WP_017302658.1 | 515872075 | protein [Spirulina subsalsa] | 27.69 | | MAKIIARIGGIGNQIFIYAAARRLELINNAELVLDSVSGFVHDLQYRQHYQLDHFHIPCRKATPABRFEPPSR VRRYLKRQLNQRLPFEQRRVVIQESIDFDPRLIEFKPRGTVHLEGVWQSEDFYKDIEATIRQDLQIQPPTDPTN LAIVQHIHQHTSVAVHIRFFDQPNADTMNNAPSDYHRAVEAMETFVPGAHYLFSDQPEAAKSRIPLDE RVTLVNHNRGNKLAYADLWLMTCQHFIIANSTFSWWGAWLAENQKKQVIAPGFEKREGVSWWGFKGL LPKQWIKL | 55 |

TABLE 1-continued

| Bacterium names | Accession No. | GI No. | Gene name [bacterium] | % identity FutC | Alias | SEQUENCE | SEQ ID NO |
|---|---|---|---|---|---|---|---|
| Vibrio cyclitrophicus | WP_010433911.1 | 498119755 | glycosyl transferase family 11 [Vibrio cyclitrophicus] | 27.67 | | MVIVKITGGLGNQLFQYATGSALANKLSCEIVLDLSFYPTQTLRKYELAKFNINARVATDREIFLAGGNDFFS KALKKLGLTSIIFPEYIKEQESIKVVGKIDLCKSGAYLDGYWQNPLYFSQNKIELTREFLPRAQLSPASALAWKDHI SQASNSVSLHVRRGDYVENAHTNNIHGTCSLEYYQHAIEKIRSEVINPVFVFSDDIEWCKLNLSLAEVEFV DNTTSAIDDLMLMRQCKHSIIANSTFSWWGAWLKLDGLVIAPRNWFSSASRNLKGIYPKEWHIL | 56 |
| Lachno-spiraceae bacterium NK4A179 | WP_022783177.1 | 551039510 | protein [Lachno-spiraceae bacterium NK4A179] | 27.65 | | MRSVVDIKGGYGNQLFCYSFGYAVSKETGSELIIDTSMILDMNNVKDRNYQLGVLGITYDSHISYKYGKDFLSR KTGLNRLRKKSAIGFGTVFKEKEQYVYDPSVFEIKRDTYPDGFWQSSRYFEKYSDDLRKMLKPKKISNAAEKL AEDARDCLSVSVHIRRGDYVSLGTWLKDDYYIKALDIIKERYGSEPVFFVFSDNKKYADDFFSAAGLKYRLMD YETDDAVRDDMFLMSRCSHNIMANSSYSWWGAFLNDNKDKTVICPETGVWGGDFYPEGWMKVTASSGK | 57 |
| uncultured bacterium | EKE02186.1 | 406980610 | glycosyl transferase family protein [uncultured bacterium] | 27.57 | | MIIVNLYGGLGNQMPQYALGRHLABKNNTELKLDISAFESYKLRKYELGNLNIIEKFALPEEISRLSTLPTGKIER FIRKTLRKPVKKPESYKENITGGFNPKILLDQNNIYLEGYWQSEKYFIEIEDIIRKEPSFKPATGKKNEILENILNI NSVSLHIRRGDYVTNPEVNQNHGVCSLDYYKSCVDFIEKKLESPYFYIFSDDIEWKNNLQIQSQVYYVDHNT VDNAIEDMRLMFSCHNKILANSSFSWWGAWLNSNPDKMVITPRKWFNTTYDSNDLIPERWIKL | 58 |
| Bacteroides fragilis; Bacteroides fragilis HMW 616 | WP_05822375.1 | 492366053 | protein [Bacteroides fragilis] | 27.46 | | MKIGIIYIVTGPYIKRWNEFYSSSQLYFCVEAEKNYEVFTDSSELASQRLPNVHMLIEDKGWIVNSSKSVFIC EIRNQLTSYDYIFYLNGNFKFISPIYCDEILPQAEHNYLITALSFSHYLTIHPDHYPYDRNKNCNAFIFYGQGKYYF QGGFYGGRTQEVLSLSEWCRDAIEADFNKKVIARFHDESVINRYLLTQHPKVLNKKYAFQDIWPYEGEYKAIV LNKEEVPEDNNLQEMKQNYIDPSLSFLLNDELKFIPISIVQLYGGLGNQMPGYAFLYIRHISTQERKLLIDPAP CKRYGNHNGYELPSIFSKICQHIHISDETKNNIRLRKGTSLSIEEVRASMPGSPKEKKQPIIFYSGCWQCVTYV ETVKDEIKKDFIFDESKLNEPSAQMRIIRRSNSVNVHIRNDYLIGNNEFLYGGICTKSYEKAISQMYTLLKDE PIFIYFTDDPEWVRSNPALDKSYLVDWNKNDNWQDMYLMSACRHHIIANSSFSWWAAWLGGFPEKKVI NYAGDLFDELYEEIHKGISFSFLDGLCGIAWAVEYLVHEQFIEGNTDDSLAEIDFKVMQIDPRRFTDYSFETGL EGIACYVLSRLLSPRVCSSSLTLDSVYLKDTLEACRKVPDKANYTRLFLNYIESKEVGYSFKDVLMQVLNHSEK AFPGSDGLTWQTGLTMIMR | 59 |
| Butyrivibrio sp. AE3009 | WP_022778576.1 | 551034739 | protein [Butyrivibrio sp. AE3009] | 27.46 | | MIIIQLKGGLGNQMFQYALYKELRSRGKEVKIDDVTGFVDDELRTPVLQRPGIEYDRATREEVVKLTDSKMDI FSRIRRKLTGRKTCRIDEESGTFNPDILELDEAYLVGYWQSDKYFRNEDVIAQLRQEFQKRPQEIMTDSASWA TLQQIECCQSVSLHIRRTDYIDEEHNHIHNLCTEKYYKGAIDRIRSQYPSAVFFIFTDDKEWCRNHFRGPNFFV VELAEKENTDIAEMLLMSSCKHHICANSSFSWWSAWLNDSPEKMVIVPNKWINNRDMDDIYTDRMTKM AI | 60 |
| Bacteroides avatus; Bacteroides ovatus CL02T12C04 | WP_004317929.1 | 490447027 | protein [Bacteroides ovatus] | 27.43 | | MKQTIILSGGLGNQMFQYAFFLSMKAKGKSCSLDTTLFQTNKMHNGFELKSVFDIPDSPNQASALHSLLIKM LRRYKPKSILTIDEPYTFCPDALESKKSFLMGDWLSPKYFESIKDVVVNAYRFHNIGNKNVDTANEMHGNNS VSIHIRRGDYLKLPYYCVCNENYYRQAEIEQIKDRVDNPIFYVFSNEPSWCDSFMKEFRVNFKIVNWNQGKDS YQDMYLMTQCKHNIIANSTFSWWGAWLNNNTDKIIVAPSKWFKNSEHNINCKEWLLIDTSK | 61 |
| Desulfospira joergensenii | WP_022664368.1 | 550911345 | protein [Desulfospira joergensenii] | 27.42 | | MGKKVVETVVNGGLGNQIFQPSAGFALSKRLNLDLVLNISTFDSCQKRNFELYTPKIKNSFACIKDDDPGVFS RLRIPLNFKEKIKQFHESHFFPDPAFFDIREPVRIEGYFQSYKFPEKYSDQLKDILLDPLTSRLKTVLKVISSKES VSVHIRRGDYISDQGINEVHGTLNEAYYLNSILKLMEKMFPESFFFFLFTDDPHYVENFKFLEDTSCIISDNDCLP YEDMYLMANCHHNIIANSSFSWWGAWLNQPEKIVIAPRKWFSRKILMEKPVMDLLPDDWILL | 62 |

TABLE 1-continued

| Bacterium names | Accession No. | GI No. | Gene name [bacterium] | Alias | % identity FutC | SEQUENCE | SEQ ID NO |
|---|---|---|---|---|---|---|---|
| Lachno-spiraceae bacterium 10-1 | EOS74299.1 | 507817890 | protein C819_03052 [Lachno-spiraceae bacterium 10-1] | | 27.39 | MNIIRMTGGLGNQMFQYALFLRLKAQGKEVKFDDRTEYKGBEARPILLWAFGIDYPAAGEEVNELTDGV MKFSHRLRRKLFGRKSKEYREKSCNFDQQILEKEPAYFTGYFQSERYFEEVKEQVRKAFQFSGKIWGSVSKEL EERIREYQTKIENKSQMPVSVHIRRGDYLENDEAYGGICTDAYYRKAIEMMEEKFNTVFYIFSNDTGWAKQ WIDHFYKEKSRFIVIEGTTEDTGYLDLFLMSKCRAHIIANSSFSWWGAWLDPDQEKIVIAPSKWVNNQDMK DIYTREMKISPKGEVR | 63 |
| Bacteroides dorei; Baceroides dorei DSM 17855 | WP_007832461.1 | 495107639 | protein [Bacteroides dorei] | | 27.33 | MVVVYGAGLARNMFQYAFALSLREKGLDVFIDEDSFIPRPDFERTKLDSVFVNVNIQRCDKNSFPLVLRED RFYKLLKRISEYMSDNRYIERMNLDYLPIHKKASTNCIFIGFWISYKYFQSSEDAVRKAFTFKPLDSIRNVELAT KLVTENSAVHFRKNIDYLKNLPNTCPPSYYYEAINYIKKVVPNPKFYFFSDNWDWRENIRGVEFTAVDWN PSSGIHSHCDMQLMSLCKHNIIANSTYSWWSAYLNENNNKIVVCPKDWYGGMVKKLDTIIPESWIING | 64 |
| Firmicutes bacterium CAG:24 | WP_021916201.1 | 547127421 | protein [Firmicutes bacterium CAG:24] | | 27.32 | MVKVKMSGGLGNQMFQYALYRKIQQTGKDVKLDLFSFQDKNAFRRPSLDIFPIEYQTANLEECRKLGECSYR PVDKIRRKMFGLKESYYQEDLDGYQPEILEMNPVYLDGYWQCERYFQDIREKILEDYTFPKKISIESSRLQERI KNTESVSIHIRRGDYLDDAANYKIYGNICTIEYYQSAISRMRKLCEKPNFYLFSNDPEWAKEIFGDTEDTIVEEDK ERPDYEDMFLMSRCKHNIIANSSFSWWAAWLNQNENKRVIAPVKWFNNHSVTDVICDDWIRIDGDHKGA | 65 |
| Clostridium hatheway:224 | WP_022031822.1 | 547299420 | epsH [Clostridium hathewayi CAG:224] | | 27.3 | MIYVNIRGRLGNQLFIYAFARALQKSTNQQITLNYTSFRKHYNNTAMDLEQFNIPEDIMFENSKELPWFANT DGKVIRILRHYPPKLJIRSILQKMNVLMWLGDEYVEVKNKRDIYIDGFWQSSRYFKSVYKELKNELIPKMEM SKEIKTMGDLINQKESVCVSVRRGDYVTVKKNRDYICDEKYLNTSIMRMVELPNVTWFIFSDDADWVK DNIVFPGEVFYQPPRVTPLETLYLMKACKHFIISNSSFSWWGQYLSNNDNKIVIGPAKWVDGRKTDIIEEE WIKIEV | 66 |
| Syntrophus acidi-trophicus SB; Syntrophus acidi-trophicus | YP_462663.1 | 85860461 | alpha-1,2-fucosyl-transferase [Syntrophus acidi-trophicus SB] | | 27.3 | MVIVRLTGGIGNQMFQYAAARRVSLVNNAPLFLDLGWFQETGSWTPRKYELDAFRIAGESASVGDIKDFKS RRQNAFFRRLPLFLKKRIFHTRQTHIIEKSYNFDPEILNLQGNVYLDGYWQSEKYFSDVDSEIRREFSFQTDPAE RNRKILERIASCESVSIHIRRGDYVTLPDANAFHGLCTPAYYRLAVEQISRKVVEPVFFVFSDDIAWARGNLKL GFETCFMDQNGPDRGDEDLRLMIACRHHIIANSSFSWWGAWLCSNPEKIVYAPRKWFNNGLDTPDNIPAS WIRI | 67 |
| Bacteroides caccae; Bacteroides caccae ATCC 43185 | WP_005678148.1 | 491931393 | protein [Bacteroides caccae] | | 27.27 | MKIVIKIIGLGNQMFQYALYSLKKKYPKEKIKIDISMPETYGLHNGPELKRIFDIDAEYASREEIRELSFYIKIYKL QRIFRKIFPVRKTECVEKYDFKFMSEVWSNCDRYEGYWQNWEYFIEAQTEVRSTPTFKELVGRNAKVIREI QYAKMPVSLHIRRGDYLDHKLFGGLCDLNYYKKAIDYVLNNYDTPQFVLFSNDIEWCKTYILPLVQGPFIIVD WNSGVESYIDMQLMSSCCRINIIANSSFSWWAAWLNDSSEKIVIAPKLWAHSPYGKEIQLKSWLLF | 68 |
| Butyrivibrio fibrisolvens | WP_022756304.1 | 551011888 | protein [Butyrivibrio fibrisolvens] | | 27.24 | MIIIEMSGGLGNQMFQYALYKSMLHKGDLVTIDKSIYRDVDHKEQVLDRFPNVSYIEADRKLSSTLRGYGY NDSIIDKIRNKLNKSKRNLYHEDLDKGYQPEIFEFDNYLNGYWQCERYFKDIKNEIKKDFIFPCTQSGDDKIK ALTIEMBSCNVSLHVRRGDYLKPGLIETYGNICTEEYYKKSIEYIKERVDNPVFYIFSNDMAWVRDNFKSDDFR YVNEDGAFDGMTDMVLMTRCRHHIVANSSFSWWGAWLNKHDDNIVICPNRWVNTHTVTDIIICEDWIRI DV | 69 |

TABLE 1-continued

| Bacterium names | Accession No. | GI No. | Gene name | % identity FutC | Alias | SEQUENCE | SEQ ID NO |
|---|---|---|---|---|---|---|---|
| Parabacteroides distasonis; Parabacteroides distasonis CL03T12C09 | WP_005857874.1 | 492476819 | protein [Parabacteroides distasonis] | 27.24 | | MIVGGNDYCKVKVVNIIGGLGNQMFQYAFALSLKEHFPKEEIRIDISHFNVLFVNKVGAANLHNGYELDKIFF NIELKKCANAWQLMKLTWFIPNYLISRIARKILPVRNSEYIQNSSDCFFYDPMVYNKQGSCYEGVWQAIGYYE SMRDKLCKIFQHPSPEGKNKQYIENMESSNSVGIHIRRGDYLLSDNFRGICEVDYKRAIDKILQDGEKHVFYL FSNDQKWCEEYILPLLGNYEIIFVTGNIGRDSCWDMFLMTHCKDLIIANSSFSWWGAFLNKRGRVVTPKR WMNRNIRYDLWMPEWIRI | 70 |
| Geobacter uraniireducens; Geobacter uraniireducens Rf4 | YP_001230447.1 | 148263741 | glycosyl transferase family protein [Geobacter uraniireducens Rf4] | 27.21 | | MIIARLQGGLGNQMFQYAVGLHLALTHNVELKIDITMFSDYKWHTYSLRPFNIRESIATEEEIKALTDVKMDR PYKKIDNFLCRLLRKSQKISATHVKEKHFHYDPDIIKLPDNVYLDGYWQSEKYFKEIENIIRQTFIIKNPQLGRDK ELACKILSTESVCLHIRRGNVTDKTTNSVLGPCDLSYYSNCIKSLAGNNKDPHFPVFSNDHEWVSKNLKLDYP TIYVDHNNEDKDYEDLRLMSQCKHHIIANSTFSWWSAWLCSNPDKVIYAPQKWFRVDEYNTKDLLPSNWLI L | 71 |
| Lachnospiraceae bacterium A4 | WP_012280341.1 | 511026085 | protein [Lachnospiraceae bacterium A4] | 27.21 | | MIIVKIYEGLGNQLFQYAFARSIQVNGKKVFLDTSGYTDQLFPLCRTSTRRRYQLNCFNIRIKEVEKKNIEKYSFL IQEDMFGKLISKLAKLHLWMYKVTIQQNAQEYKESYLNTRGNVYKGWFQNPKYFSSIRRLLKEITPKYKIRI PAELRELLQEDNIVAVHCRRGDYQYIRNCLPVNYYKKAMAYMKEKKLGVPRYLFFSDDLSWVKRQFGNKDN | 72 |
| Colwellia psychrerythraea; Colwellia psychrerythraea 34H | YP_270849.1 | 71282201 | alpha-1,2-fucosyltransferase [Colwellia psychrerythraea 34H] | 27.15 | | MKVVRVCGGFGNQLFQYAFYLAVKHKFNETTKLDIHDMASYELHNGYELERIGNLNENYCSAEEKLAVQSTK NIFTKLLKEIKKYTPFIPRTYIKEKKLHHFSYQEVDLGTKDTSIYRGSWQNPQYFNSIASEIREKLTFPEFTEPKSL ALHQEISEHETVAVHIRRGDYLKHKALGGICDLPYYQNAIKEIEGLVEKPLFVIFSDDITWCRANINVEKVRFVD WNSGEQSFQDMHLMSLCTHNIIANSSFSWWGAWLNANPNKIVISPNKWIHYTDSMGIVPSEWIKVETSI | 73 |
| Roseobacter sp. MED193 | WP_009810150.1 | 497495952 | alpha-1,2-fucosyltransferase [Roseobacter sp. MED193] | 26.96 | | MITSRLHGRLGNQMFQYAYGLCGVALDGRGAELRGEGVLTRVFDLPLSAAPKLPPLKQHAPLRY GLWRGLGLAPRFRRERGLGYNTAFETWEDGCYLHGYWQSERYFEEISDLIRADFTFPDFSNRQNAEMAARI MEDNAISLHVRRGDVVALSAHVLCDQAYYREALTRLLEGLSQDAPTVYVFSDDPDWAKANLPLPCKKVVVD FNGPETDFEDMRLMSLCKHNIIGNSSFSWWAAWLNANPQKRVAGPANWFGDPKLSNPDILPSQWLKVA P | 74 |
| Cesiribacter andamanensis; Cesiribacter andamanensis AMV16 | WP_009197396.1 | 496488826 | Glycosyl transferase family 11 [Cesiribacter andamanensis] | 26.89 | | MMIVRLCGGLGNQLFQYAVGKQLSVKNNIPIKIDDSWLRLPDARKYRLQFFQIEEPLASPQEVERFVGPYES QSLYARLYRKVQNMLPRHRRRYFQESGFWAYEPELMRIRSQVFLEGFWQHHAYFTRLHPQVLEALQLREEY RQEPYAVLDQIREDAASVSLHIRRGDYSDYNLQPFFGYNLPLSYYQQVAYMQEQLHAPTFYIFSDDLDWA RAHLKLQAPMWFVDIEGGRKEYLELEAMRLCRHNILANSSFSWWGAYLNTNPHKRVIAPRQWVADPELKD KVQIQMPDWILL | 75 |
| Rhodopirellula sallentina; Rhodopirellula sallentina SM41 | WP_008679055.1 | 495954476 | glycosyl transferase family 11 [Rhodopirellula sallentina] | 26.89 | | MIATRLIGGLGNQMFQYAYGFSLARRSERLVLDVSAFESYDLHALAIDQPDISAARMTQAEFARIPGRYRG KSRWAERVANFAGGLQSCDKRPLRLRREKPGFAEKYLAEGSDLYILDGYWQSERYFPGLQAELKEFQLKRG LSDESSRVLDEIQSSMSVAMHVRRGDYVTNAETLRIYRRLDAEYYRKCLNDLRQRFSNLNVFVFSNDIQWCQ DHLDVGLKQRPVTHNDATTAIEDMFLMSQCDHSIIANSSFSWWAAFLGRSDAQRRVYYPDPWFNPGTLN GDSLGCANWVSESSISVSRPSRAA | 76 |

TABLE 1-continued

| Bacterium names | Accession No. | GI No. | Gene name | % identity FutC | Alias | SEQUENCE | SEQ ID NO |
|---|---|---|---|---|---|---|---|
| Butyrivibrio sp. AD3002 | WP_022762282.1 | 551018054 | protein [Butyrivibrio sp. AD3002] | 26.85 | | MIIIRMMGGLGNQMFQYALYIQLKALGKEVKIDDVVGFRDDPQRDPVLEKMYGIIYTKASDAEVVDITDSH LDIFSRIRRKLFGRKSHEYIEETGLFDPKVFEFETAYLNGYFQSDKYFPDKEVLAQLRREFVIKPDDVFTSADSE ELYRQIRETEVSIHVRRGDYLLPGIVETFGGICDNDYYKRAIDRMWSEHPDAIFVFTSDKEWCEQNVSGKK FRIVDTKEENDDAADLLMSLCKHHILANSSYSWWGSAWMNDSPEKTVIVPSKWLNTKPMDDIYTSRMTKI | 77 |
| Segetibacter koreensis | WP_018611017.1 | 517440157 | protein [Segetibacter koreensis] | 26.78 | | MVVKLIGGMGNQMFQYAIGRHLAIKNKCPLYFDHIELENKNTANTPRNYELDIFNVQYQKNPFLQSNRFV AKVYHKLFSVQRIKEPDFTFHPHILNVQGNIHLNGYWQNENFKEIEIIRQDFTFKTPANEKIESILQQIAATN SVSLHVRRGDYITLTEANQFHGVCSDTYYQKAIAKIKEAIPAPHLFVFSDDIHWVKQNMPFTEEHTFVDGNT GKNSFPDLRLMAACRHNILANSSFSWWAGWLNKNPEKMVIAPEDWFRAVHTDIVPPSWIKM | 78 |
| Amphritea japonica | WP_019621022.1 | 518450815 | protein [Amphritea japonica] | 26.76 | | MVIVRLIGGLGNQLFQYAYALSLLEQGYDVKLDASAFESYTLHGGFGLGEYAERLEVATTEVDMVSRVGRIS TLLRKLQGKKSRRVIKESNFSYDEKMLTPEDSHYLVGYFQSELYFNKIRGELLSALDLKHKLSPYTEASYLAIADA SVSVSMHIRRGDYVSDKAAHNTHGVCSLDYYAAVTFFEERYPDVDFYIFSDDIEWVKENLNVQRAHYISSEE KRFAGEDIYLMSQCDHNIVANSSFSWWGAWLNANEDKIVVAPRQWYADSNMQRLSKTLVPDTWIRL | 79 |
| Desulfovibrio vulgaris; Desulfovibrio vulgaris; str. 'Miyazaki F' | YP_002437106.1 | 218887785 | glycosyl transferase family protein [Desulfovibrio vulgaris str. 'Miyazaki F'] | 26.76 | | MRPVVVDIFGGLGNQMFQYAAAKSLAERLGVRLELDVSMFSGDPLRAFSLGEFAITDHVRGKSRSSLLVRPA RSLGFGSSSKCVEPPFHYWEGINEIEAPVHMHGYWQSEKYFKAYEDLIRETFSFSACEGVASSGKYAGVSSP MSVSVHLRRGDYKEQKNVVVHGILGREYYDAAYSIIKQGCPSACFVFTDAINEAVDFFSHWNDVLFVDGN NQYQDMYLM SQCRHHIIANSSYSWWGAWLGAFSDGMTVAPKMWFAYDVLKEKSIKDLFPEDWIVL | 80 |
| Spirosoma spitsbergense | WP_020606886.1 | 522095677 | protein [Spirosoma spitsbergense] | 26.76 | | MIISRITSGLGNQLFQYAVARHLSLKNKTSLVDLSYYLYQYHDDTSRNFKLGNFSVPYHTLQQSPVEYVSKAT KLLPNRSLRPFFLFQKERQFHFDEQILQSRAGCVILEGFWQSEAYPRDNADTIRRDLQLSGTPSPEFNQYRELI RETPMSVSIHVRRSDYVNHPEFSQITFGFVGIDYYKRAIELARKELANPRFFVFSDDKEWSKTNLPLGEDSVFV QNTGLNGDVADLVLMSHCQHHIIANSSFSWWGAWLNPNAGKLVITPKNWYKNKPAWNTKDLLPPTWLS I | 81 |
| Lachno-spiraceae bacterium 28-4 | WP_016292012.1 | 511037988 | protein [Lachno-spiraceae bacterium 28-4] | 26.73 | | MNIIRMSGGIGNQMFQYALYLKLIVSLGKEVKFDDVTEYELDNARPIMLSVFGIDYPKASREELVELTDASMD FLSRVRRKIFGRKSGEYHEASADYDETVLEKEHAYLCGCFQOSERYFKDIYEVREAYRFRNVVVPEIRGGIETY ERQIGESLSVSIHIRRGDYLDAADVVGGICTDAYYNQAIRYMIKKYENPSFFVFTNDTFWAEKWCEVRBERETG KRFTVIKGTDEETGYIDLMLMSRCKAHIIANSSFSWWGAWLDASPDKCVVAPVKWINTRECRDIYTEDMVR IGSNGKISFSNCSSL | 82 |
| Lachno-spiraceae bacterium COE1 | WP_016302211.1 | 511048325 | protein [Lachno-spiraceae bacterium COE1] | 26.71 | | MVVRIWEGLGNQLFQYAYARALSLRTKDRVYLDISEYEMSPKPVRKYELCHFKIIKQPVINCGRIFPFVNKDS FYTKNNQYLRYFPAGLIKEEDCYFKRFDFCELKGLYLKGYKFEFESHIREEIYPRNKIKITRGLRKILNSD NTVSVHIRRGDFGKDHNILPIEYYENSKRVILERVDNPYFIIFDDILMVKENMNGLNCFRYMDKEYSYKDYEE LMIMSRCKNIIANSTFSWWGAWLNPSKDKIVIAPKKWFLYNPKKDFIVPNDWIRV | 83 |

TABLE 1-continued

| Bacterium names | Accession No. | GI No. | Gene name [bacterium] | % identity FutC | Alias | SEQUENCE | SEQ ID NO |
|---|---|---|---|---|---|---|---|
| Parabacteroides; Parabacteroides sp. 20_3; Parabacteroides distasonis CL09T03C24 | WP_005876692.1 | 492502331 | alpha-1,2-fucosyl-transferase [Parabacteroides] | 26.69 | FutZB | MKIVNIIGGLGNQMFQYAFAVALKAKYPNEEVFIDTQHYKNAFIKVYHGNNFYHNGYEIDKVFPNATLEPAR PKDLMKVSFYIPNQVLARAVRRIFPKKTEFVTDQQPYVFIPEALSVIDDCFYDGYWMTPLYFDKYRDRILKEF TFRPFDTKENLELEPLLKQDNSVTVHIRRGDYVGSSFGGICTLDYYRNAIREAYNLITSPEFFIFSNDQKWCM ENMRNEFGDAKVHFIAHNRGADSYRDMQLLSIARCNILANSSFSWWGAYLNQRKNCFIICPHKWHNTLEY SDLYLPTWIKI | 84 |
| Bacteroides sp. HPS0048 | WP_002561428.1 | 488624717 | protein [Bacteroides sp. HPS0048] | 26.62 | | MFVIRLIGGVGNQLFQYTFGQFLRHKFPGVEVCYDIVAFDTVDKGRNLELQLLDESLPLFETSNFFSKYKSWK KRLFLIYGFLLKKNNKYYTKYAPEEISLFTEKGLSYFDGWWQYPALLRDTINNMEDFFIPKQPIPVQIQKYYNEIL LNNFAVALHVRRGDYFTSKYAKTYAVCNVEYYTSAVNLMCEKLRSCKFYVFSDDLDWVKSNLILPSNTVVK NYDINSYWYIYIMSLCHHIISNSSFSWWGATLNRNFHKIVIAPKYWSTKKNNTLCDNSWIKI | 85 |
| Bacteroides thetaiotaomicron; Bacteroides thetaiotaomicron dnLKV9 | WP_016267863.1 | 511013468 | protein [Bacteroides thetaiotaomicron] | 26.58 | | MKIINILGGLGNQMFEYAMYLALKNAHSEEEILCSTRSFCCYGLHNGYELGRIFGIQVKEASLLQLTKLAYPFF NYKSWQVMRHWLPVRKTMTRGAINIPFDYSQVMREDSVYDGYQWNEKNFLHIREEILTAYTFPKFDDEK NQELADIIVKSNAVSCHIRRGDYLKEINMCVCTSSYYAHAISYMNEEINPNLYCVFSDDIEWCRNNICELMGE DKKIIPIDWNKGEKSFRDMQLMSLCKHNIIANSSFSWWGAWLNRNDKKIVVAPTRWIASEVKNDPLCDSW KRIE | 86 |
| Desulfovibrio alaskensis; Desulfovibrio alaskensis G20 | YP_389367.1 | 78357918 | glycosyl transferase [Desulfovibrio alaskensis G20] | 26.56 | | MKFVGWNILGGLGNQMFQFAAAYALAKRMGGELRLDLSGFKKYPLRSYSLDLFTVDTPLWHGLPMSQRRF RIPMDAWTRGSRLPLVPSPPFVMAKEKNFAPSPIVVELQQSCYLYGVWQSYRYFQDVEDDIRTLFSLSRFATL ELAPVVQLNEVESVAVHLRRGDYITDAASNAVHGVCGIDYYQRSMSLVRSTTKPIFYIFSDEPVAKKLFAT EDDVVVMPSRRQEEDLLLMSRCKHHIIANSSFSWWAAWLGKRASGLCIAPRYWFARPKLESTYFDLIPDE WLLL | 87 |
| Prevotella oralis CC98A | ETD21592.1 | 564721540 | protein HMPREF1199_ 00667 [Prevotella oralis CC98A] | 26.56 | | MDIVVIFNGLGNQMSQYAFYLAKRKSGSRCHCIFHNVSTGPHNGSELDKVFGIKYEKGIFSKLLSKIYDIFDGIP KLRKKLNSLGLIHIIREPRNYDYTASLLPRVSRWGLNYFVGGWHSEKYYTEILQEIKNTFSFKIDDEIKDIDFYEFYS LIHNDINSVSLHIRRGDYVGANEYSYFQFGGVATLEYYHKAIDEIYQRIENPTFYVFSDDIGWCKTFLKNNFIF VDCNCGEKSWRDMFLISQCKHHIIANSTFSWWGAWLSIFHNSITICPKEFIKGVVIRDVYPDTWIKLSS | 88 |
| Comamonadaceae bacterium CR | YP_008680725.1 | 550990115 | glycosyl-transferase [Comamonadaceae bacterium CR] | 26.54 | | MASKISKIIPRIFGGLGNQLFIYAAARRLALVNGAELALDLVSGFVRDHEYNRHYQLDHFNIPCRKATAERLE PFARVRRYLRKKWNQRLPFEQRKYLVQESVDFDERLLTFKPRGTVVLEGVWQSEDYFKDIEPPQIRADLRIHPP TDTVNQQMAEBIRATNAVAVHVRFFDAPAQSALGVGGNNAPGDYYQRAIKMQEOAPDAQYYIFSDQP QAARARIPLRDDHVTLVNHNQCDAVAYADLWLISQCQHFIIANSTFSWWGAWLGKTPESIVIAPGFEKREG AMFWGFRGLLPDRWVKL | 89 |

TABLE 1-continued

| Bacterium names | Accession No. | GI No. | Gene name | % identity FutC | Alias | SEQUENCE | SEQ ID NO |
|---|---|---|---|---|---|---|---|
| Vibrio nigripulchritudo; Vibrio nigripulchritudo AM115; Vibrio nigripulchritudo Pon4; Vibrio nigripulchritudo SO65 | WP_022596860.1 | 550250577 | WblA protein [Vibrio nigripulchritudo] | 26.51 | | MKDSRIVKLNGGLGNMFQFALAFALKKKLNVAVKPDTELLDTNRTEFKSLERFGLIVDKLTITEKFKYKGLE SCKYRKICNWISNFTTINIHKGYYKEKERGVYDRGIFDSNVKYIDGYWQNQEYFNDFRSELLNKFNLNGKVSN HAIQYLKEITSVQNSVSIHVRGDYLLLDVYRNLTLDYYSEAIKLVRITNPDSKFFIFSNDINWCKSNFKSVDNAI FVDSTVDEFDDMFLMSKCKTNIIANSTFSWWAAWLNNSGKIVYCPKKWRNDTTENHKGLPEGWNIIDK | 90 |
| Sulfurospirillum deleyianum; Sulfurospirillum deleyianum DSM 6946 | YP_003304837.1 | 268680406 | glycosyltransferase family protein [Sulfurospirillum deleyianum DSM 6946] | 26.48 | | MIIIKIMGGLTSQMHKYALGRVLSKYNVPLKLDLTWFDNPKSDTPWEYQLDFNINATIATVSEIKKLKGNN LFNRIARKIEKFFSIRIYKKSYINKSFISISDFHKLKSDIYLDGEWNGFKYFEDYQDTIKNELTLKRGSSINIQNTIE LKSSDNSVFLHIRRGDYLSNKNAAAPHAKCSLDYYYKAIQIVKEKIDNPIPYISDDILWVKKNFVINESCRFME KNQNFEDLLLMSYCKHGITANSGFSLMAGWLNQNKDKMIIVPQTWVNDDRINININLNSLEQDNFTIIR | 91 |
| Escherichia coli; Escherichia coli Jurua 18/11; Escherichia coli 180600; Escherichia coli P0304777.1; Escherichia coli P0304777.2; Escherichia coli P0304777.3; Escherichia coli P0304777.4; Escherichia coli P0304777.7; Escherichia coli P0304777.9; | WP_001581194.1 | 486318742 | glycosyl transferase 11 family protein [Escherichia coli] | 26.47 | | MTFIVRLTGGLGNQMFQYALARSLAKKYNARLKLDISYYHNQPHKDTPRTFELNQLCIVDNILNSSSFSEKFLY IYDKLRVKLSKKISLPYFRNIVTPVNFNCIDFAEDKDYFLGHFQELSNIYSIDESLRSEFKPNQEIMNLAHQSKIY ELIKQSRGSVALHIRRGDYVTNKNAAEHHGVIGLSYVNALSYLENVSEFFDVFVFSDDPEWARKNIKNSRNL FFCDEGNCRYSKKYSTIDMYLMSQCDHFIIANSTYSWWAAWLGNYPSKHVVAPARWNANNSPYPILQNW KAIHE | 92 |

TABLE 1-continued

| Bacterium names | Accession No. | GI No. | Gene name [bacterium] | % identity FutC | Alias | SEQUENCE | SEQ ID NO |
|---|---|---|---|---|---|---|---|
| Escherichia coli P0304777.10; Escherichia coli P0304777.11; Escherichia coli P0304777.12; Escherichia coli P0304777.13; Escherichia coli P0304777.14; Escherichia coli P0304777.15 | | | | | | | |
| Firmicutes bacterium CAG:24 | WP_021914998.1 | 547109632 | protein [Firmicutes bacterium CAG:24] | 26.44 | | MVGVQLSGGLGNQMFEYALYLKLKSMGKDVRIDDVTCYGAQEKQRVNQLSVFGVSYEHMTKQEYEQITD SSMSPLHRARRLLCGRKDLSYREASCNYDPEILREPALLLGYFQTERYPADIKDQVREAFTFRNLTLKESAA MEQQMKECESVSVHIRRGDYLTPANQALFGGICDLDYYHRAVAEIRKRKPDVKFPLFSNDMEWTKEHFCGS EFVPVEGNSEQAGEQDLYLMSCCKNHILANSSFSWWGAWLDNGKDKLVIAPEKWMNGRGCCDIYTDEMI RV | 93 |
| Amphritea japonica | WP_019622926.1 | 518452719 | protein [Amphritea japonica] | 26.42 | | MVKIKIGGLGNQMFQYAAAKSLAVLNNTRVSANVVSFSNYKTHPLRLNKLNCDCEFDFTRDFRLVLSGFPLL GSAFSKKSMLLNHYVEKDLLFDSSFFLDDNVLLSGYFQSEKYFSNIRELLIQEFSLDDRLTEAELAINNKIESCN SIAIHIRRGDYITDLSANNIHGICSEYFEKALNYLDSINVLSDPTTTLFIFSDDILWCKDNLAFKYRTVFVEGSVD RPEVDIHLMSKCKHQVISNSTFSWWGAWLNTNLDKCVIAPLKWFNSLHDSTDIVPKQWMRL | 94 |
| Bacteroides salyersiae; Bacteroides salyersiae WAL10018 = DSM 18765 = JCM 12988 | WP_005923045.1 | 492689153 | protein [Bacteroides salyersiae] | 26.41 | | MKQTIIMSGGLGNQMFQYALYCSMREKGIRVKIDISLYEFNRMHNGYMLDYAFGLNISHNKINKYSVLWTR LIRSNRAPFLLFREDDSRFCDDVFTTYKPYIDGCWIDERYFNIKKKIISQFSFHNIDQKNLMVANMKVCNS VSLHIRRGDYLSQSMYNICNESYYKSAIEYIISRVEDSKFPIFSDDPEWCKYFMEKFNVDYEIIQHNFGKDSYKD MYLMTQCKHNIIANSTFSWWGAWLNNNAGKNVVCPSVWINGRDFNPCLEEWYHI | 95 |
| Bacteroides fragilis; Bacteroides fragilis CL03T00C08; Bacteroides fragilis CL03T12C07 | WP_005786334.1 | 492241663 | protein [Bacteroides fragilis] | 26.38 | | MDIILLHNGLGNQMSQYAFYLSKKKNGIHTSYICLSNDHNGIELDKVFGVECQMGCKKIFLLFILRLLMSNRT GFLIRKVNLLFSKIKIKLLITENLDYSFHPSFLSASPYCLAFWVGGWHHPQYYSEISSQIKEAFTFKRSLLDERNICI EKRMREPNSVCLHIRRGDYLTGINYELFGKVCNEQYYQKAIDYIEGKLSDICYYVFSNDMEWAKKILLGKNAV FVDWNRGEESWKDMYLMSKCNLIIPSNSTFSWWAWLCEHPVNIVCPKLFVYGDEQSDIYLDNWHKIE | 96 |

TABLE 1-continued

| Bacterium names | Accession No. | GI No. | Gene name [bacterium] | Alias | % identity FutC | SEQUENCE | SEQ ID NO |
|---|---|---|---|---|---|---|---|
| Bacteroides nordii; Bacteroides nordii CL02T12C05 | WP_007486843.1 | 494751435 | protein [Bacteroides nordii] | | 26.37 | MMGIEKTNMVIVRLWGGIGNQLFQYSFGEFLREDYQVDVIYDIASFGKSDKLRKLELSVVVPGIPVTTDISFSK YVGTKNRLLRFIYGLKNSFIEEKYFSDEQLFKYLSKRGDVLQGVWQKTIYAETLRRKGSFFLSQEEPIVLHTIKA KIQEAEGAIAHVRRGDYFSSKHINTFGVCDAHYYEKAVDIMRGRVSNAMIFVFSDDLDWRRYVNLPTNVI YVPNYDIPQYWYIYLMSLCRHNIISNSSFSWWGAFLNMNTNKIVVSPSKWTLNSDKTIALDEWFKI | 97 |
| Butyrivibrio proteoclasticus; Butyrivibrio proteoclasticus B316 | YP_003829743.1 | 302669783 | glycosyl transferase 11 [Butyrivibrio proteoclasticus B316] | | 26.37 | MECSMIIIKFCGALGNQLFQYALYEKMRILGKDVKADISAPGDGNEKRFFYLDELGIEFNIASADEIAEYLNRKT IRFVPGFLQHRHYYFEKKPYVYNKKLLSYDDCYLEGVWQNYRYFDDIKDELLKHMKFPCLPLEQKKLAEKMEN ENSVAVHVRMGDYLNLQDLYGGICDADYYDRAFSYIEGNISNPVYYGFSDDVDKASALLAKHKINWIDYNSE KGAIYDLILMSKCKNNIIANSSFSWWGAYLEYNNGKVVSPNRWMNCFENSNIAYWGWISL | 98 |
| Prevotella ruminicola; Prevotella ruminicola 23 | YP_003574648.1 | 294674032 | family 11 gylcosyl transferase [Prevotella ruminicola 23] | | 26.33 | MRIVKVLGGLGNQMFQFALYKALQKQYFEERVLLDLHCFNGYHKHRGFEIDSVFGVTYEKATLKEVASLAYP YPNYQCWRIGSRILPVRKTMLKEEPNFTLEPSALSLPDSTYYDGVWQHEEYFMHIREEILSTYAPPAPDDERN KTTAQLAASTNSCSIHIRRGDYLTDPLRKGTTNGNYVIAAIKEMQQEVKPEKWLVFSDDIAWCQQHLASTLD ATNTIYIDWNTGANSIHDMHLMALCRHHIIANSSFWWGAWLSQQDGITIAPSNWMNLKDVCSPVDN WIKI | 99 |
| Prevotella salivae; Prevotella salivae DMS 15606 | WP_007135533.1 | 494223898 | protein [Prevotella salivae] | | 26.33 | MKIIKIIGGLGNQMFQYALAIALQQQYKDEIRLDLNCFRGYNKHQGYLLDEIFGRRFRAASLQEVARLAWPY PHYQLWRVGSRVLPRRQTMVCEPADGSFSPDVLTLEGNRYDGYWQDERYFKAYRKEIIEAFKFSPVGDG NRHVENMLRNERFASLHVRRGDYLNDALYQNTCGIDYYQRAISQMNAMNANPSCYFIFSDDIAWCKTHIEPL CEGHRPYIDWNKGKEAYRDMLMALCKYHIIANSSFWWGAWLNDAEDGITIAPQQWYSHGNKPSPAS ESWIKV | 100 |
| Lachnospiraceae bacterium COE1 | WP_016299568.1 | 511045640 | protein [Lachnospiraceae bacterium COE1] | | 26.3 | MNIVRISDGLGNQMFQYAYARKISILSRQRTYLDIRFINNEDLVKKGNHVQFRKKLGHRKYGLSHFNVSLQIA DLKMLSHWEYLIQSNCMQQLIYSLSMQDKWIWRYRHEEVNYDGMLSKVELLFPTYQGYFFALKYDDIKH ILQHDFSLKDKMKLLPEDRDALYNRNTISLHVRRGDFLEINRDISGSEYYEKAVQMIGSKVESPIFLIFSDDIEW VHEHIRIPNDKIYVSGIGYEDYEELTIMKHCKHNIIANSTFSYWAAYLNSNKDKIVICPKHWRERIIPKDWICI | 101 |
| Bacteroides dorei; Bacteroides dorei 5_1_36/D4 | WP_007842931.1 | 495118115 | alpha-1,2-fucosyl-transferase [Bacteroides dorei] | | 26.28 | MIVVNVNAGLANQMFHYAFGRKGLEAKGWNIIFYDQTNFKPRKEWSFENVQLQDAFPNLGLKMMPEGKFK WICNVVTNKLSKGLHLAMINLHNLIGDEKYEFETTYGYDPDIEKEITKNCILKGFWQSEKYFAHCKDDIRKQFS FLPFDEEKNIVIMNKMVKENSVAIIHLRKGADYLDSELMGKGLCGVEYYIKAIEYIKKNIDNPVFYVFTDNPVW VKNNLPKFDYILVDWNEVAGKKNFRDMQLMSCAKHNIIANSTYSWWGAWLNPNPNKIVIGPAKFFNPIN NFFSSSSDIMCDEDWVKI | 102 |
| Roseobacter sp. SK209-2-6 | WP_008210047.1 | 495485361 | alpha-1,2-fucosyl-transferase [Roseobacter sp. SK209-2-6] | | 26.28 | MLSKDPGMITTRLHGRLGNQMFQYAAGRALAARLGVPLADSRGAKLRGEGVLTRVFDLPLAQPLSLPPLK QDAPLRYAAWRLTGRPPRFRREQGLYGNPAFETWGDDSYLHGYWQSEAYFDSIADQIRQDFTPFEFSNSQ NREMAQRIAGSTAISLHVRRDGYVALAAHVLCDQAYYEAALTRILEGVEGSPTVVFSDDPNWAKENLPLPC EKVVVDFNGPDTDFEDMRLMSLCQHNIIGNSSFSWWAAWLNTHNEKRVAGPAHWFGNPKLQNPDILPE SWMLKISV | 103 |

TABLE 1-continued

| Bacterium names | Accession No. | GI No. | Gene name [bacterium] | % identity FutC | Alias | SEQUENCE | SEQ ID NO |
|---|---|---|---|---|---|---|---|
| alpha proteobacterium SCGC AAA076-C03 | WP_020056701.1 | 518900826 | protein [alpha proteobacterium SCGC AAA076-C03] | 26.26 | | MIYSRIRGGLGNQLFQYCVARSLADNLGTSLGLDVRDFNENSPYLMGLKHFNIRADFNPPGMIEHKKNGYF RYLIDVNGKQKFVKEPHLNPDKNIFSLPSNNYLKGYWQTEKYFIKNKVNILNDLKIISHQSDKNKTISSKIAN NTSVSLHIRRGDYISNSAYNSTHGTCSLAYYTNAVNFLVNKIGGNPKVFAPSDDDPEWVSSNLKLPVDICFVKN NSSEVIYEDLRLMSECNHNIIANSSFSWWGAWLNITNHNKTVITPCKWYADNSTKNADITPSNWIKI | 104 |
| Helicobacter bilis; Helicobacter bilis WiWa | WP_004087499.1 | 490188900 | protein [Helicobacter bilis] | 26.26 | | MGGGGQDLRLFELMLYNISLPLCFDYKTLVLVFYSNDKSLKYNFPLQYIRATRSKYHKLVLWLALKHYKYFYDE DPQGDNIVKMYLNNSLEKHAYPPGFYPQNLIYFDEIDSIIREEPCLKIPLKPHNQALKEKIEKTENSVFLHVRLGD YLKMEATDGGYVRLGKEYYQSALEIIKTRLGQPHIPIFSNDIEWCEKNLCNLLDFTGCHIEFVKANGEGNAAE EMELMRACKHAVIANSTFSWWASYLIDNPDKQIIMPTQVFNDTRRIPKSNMLAKKGYILIDPFWGMHSIV | 105 |
| Ralstonia sp. GA3-3 | WP_010813809.1 | 498513378 | glycosyl transferase family protein [Ralstonia sp. GA3-3] | 26.26 | | MIVTRVIGGLGNQMFQYAAGRALARRLGVPLKIDSSGFADYPLHNYGLHHFALKAVQAGDREIPSGRAENR WAKALRRFGLGTELRVFRERGFAVDPEVMKLPDGYTLDGYWQSESYFAEMTQELRRDFQIATPPTSENAE WLARIGGDEGAVSIHVRRGDYTVRAARYVAENIGSLDYYMRAARVAENIGSLDYYMRAARVVAENIAPAQWFRDEKYDTRDLL HLGHETRYVRHNDSARNYEDLRLMSACRHHIIANSTFSWWGAWLNASEKKVVIAPAQWFRDEKYDTRDLL PPTWTKL | 106 |
| Bacteroides ovatus; Bacteroides ovatus 3_8_47FAA | WP_004303999.1 | 490431888 | protein [Bacteroides ovatus] | 26.25 | | MVVVIAAGLANKMFQYAFSRGLMSHGLDVFLDQTSFQPEMSFEDIALEEVFPNIEIKNAPNNMFSLAYKK DLLSRIYRRMSAFFPNNRYLMERPFIYDELIYKKATNNCIPCGLWQTELYPNFCERDVRRNFVFTPFQDDQNI KLAEKMKNENSVAIHIRKGADYLKRNIWDGTCSVEYYNQAINYLKEHVSNPVFYLFTDNPEWVEENLKNIDY KLVDWNPVSGKQSYRDMQLMSCAKHNIIANSTYSWWGAWLNNNPQKIVVAPKIWFNPKIEKAPYIIPDR WIRL | 107 |
| Loktanella vestfoldensis | WP_019955906.1 | 518799952 | protein [Loktanella vestfoldensis] | 26.23 | | MIITKLIGGLGNQMFQYAAGRSLAMRHGVPLLLDITELRSYPKHQGYQFEDVFAGRFEIAGLIPLIRVLGRKAR KVPKTVAVVSPKWPMGDHVWVRQRTHDYDAAFESIGADCYLSGFWQSEKYFATIAPQIRESFRPKEALTG ANAAIASRMKEAPSAAIHIRRGDYVTDKGAHAFHGLCAWDYDAAIDHISRHEPDARFFVFSDDVVAAQER FANRQRAEVVANSGRHSYRDMMLMAQCKHQIIANSTFSWWAAAWLNQNPDKIVVAPGTWFSGNDGQI KDIYCKDWIVI | 108 |
| Flavobacterium sp. ACAM 123 | WP_016991189.2 | 515558304 | protein [Flavobacterium sp. ACAM 123] | 26.14 | | MDVVIIFNGLGNQMSQYAFYSQKKKIINNSTYFVPFCKDHNGLELETVFSLNTKETLIQKSYILFRILLTDRLKIV SDPLKWILNLFKCKIVKESFNYNYNPEYLKPSKGIIFYYGGWAEKYFAKENQQIKSVFEFTGDLGKINKEHVK DIASTNAVSLHVRRGDFMNEANIGLFGGVSTKAYFEGAIKLIATKVDHPHFFVFSNDMDWVKENLSMDTVT YVTCNSGKDSWKDMCLMSLCQHNIIPNSTFSWWGAWLNKNPHKIVVCPSRFLNNDTYTDIYPDSWVKISD Y | 109 |
| Bacteroides fragilis; Bacteroides fragilis 3_1_12 | WP_005779407.1 | 492219620 | glycosyl transferase family 11 [Bacteroides fragilis] | 26.1 | | MMKLVRMTGGLGNQMFYAFYIQMKTIFPPELRIDMSEMKKYKLHNGYELEDVFSIRPQTISAHKWLKRVIV YAFFSIIREKSEEELSIHKYTQHKRWPLVYYKGFFQSELFFKESSDTIRDIFSFNTENANFRTKEWAKIIKEQRSSV SIHIRRGDYTSAKNKIKYGNICTEEYYQKAISIILKKEPKAFFHIFSDDVEWTKAHLKIHHLPHQYISWNKGPDS WQDMMLMSLCRHNIIANSSFSWWGAWLNAYKDKTVIAPSRWSNVKKTPHILPESWISISI | 110 |
| Spirosoma panaciterrae | WP_020598002.1 | 522086793 | protein [Spirosoma panaciterrae] | 26.09 | | MIISRVTSGLGNQLFQYAAARSLSLRNKTAFYVDLSYYLYEYPDDTSRSFKLGFFSVPYRILQESPVEYLSKSTKL FPNRSLRPFFLFLKEKQFHPDPTILQAHAGCVIMEGFWQSECYFRDHAEIIRRELQLSKSPSSEFEGYHQQIQA TPVPVSVHVRRGDYVNHPEFSKTFGFIGLDYKTAIRHLIKTIKNPHFYVFSDDKEWARANLPLPTDSVFVTN TGPSGDVADLVLMSTCHHHIIANSFSWWGAWLNPNPDKLVITPKLWYKNQPTWNTKDLLPPTWSVL | 111 |

TABLE 1-continued

| Bacterium names | Accession No. | GI No. | Gene name | % identity FutC | Alias | SEQUENCE | SEQ ID NO |
|---|---|---|---|---|---|---|---|
| uncultured bacterium | EKE06672.1 | 406985982 | glycosyl transferase family 11 [uncultured bacterium] | 26.09 | | MIITKLTGGLGNQLFQYAIGRNLIYINGSDKLDVSEYDVSNKGNFRHYALDKFNTIQNFASKKETNNFKFGVF KKWLYKSGIVKNKNYPLEKKPNFDKEILKIKDNAFLQGYWQSEKYFIGIRDILLQEFSLKENIELKFGEILKEINES NSVSIHVRRGDYVKNPKNLSFHGVCSPKYYSESTSKIASLIEKPVFVFSDDIEWKENLNITFPVVYLSGIKNIK SYEELVLMSKCCKHNIIANSSFSWWGAWLNTNQKKIVIAPKRWFNDVKLDTTDLIPENWIRI | 112 |
| Thermosynechococcus elongatus; Thermosynechococcus elongatus BP-1 | NP_681784.1 | 22298537 | alpha-1,2-fucosyltransferase [Thermosynechococcus elongatus BP-1] | 26.07 | | MIIVHLCGGLGNQMFQYAAGLAAAHRIGSEVKFDTHMFDATCLHQGLELRVFGLELPEPSSKDLRKVLGA CVHPAVRRLLAGHFLHGLRPKSLVIQPHFHYWTGFEHLPDNVYLEGVWQSERYFSNIADIIRQQFRFVEPLDP HNAALMDEMQSGVSVSLHIRRGDYFNNPQMRRVHGVDLSEYYPAAVATMEKTNAERFYVFSDDPQWL EHLKLPVSYTVVDHNRGAASYRDMQLMSACRHHIIANSTFSWWGAWLNPRPDKVVIAPRHWFNVDFD TRDLYCPGWIVL | 113 |
| Colwellia piezophila | WP_019028421.1 | 517858213 | protein [Colwellia piezophila] | 26.03 | | MKIVKIAGGFGNQLFQYAFYLALDKKYAEQVCLDSLDMAKYRLHNGYELEGIFKLDARYCTEEQRIIVRKDNN IFTKLLSSLKKKLGNNKNYILEPKQEHFTFHEKSFGQANTPTYYKGWQDVKYLENIEEELKSSLVFPEFELGKNI ELANFISSNSSVSLHVRRGDYVQHKAFGGICDLSYYQRAVEQINTLVKDPIFIVFSDDIQSCKDNLNLEKAKFV DWNIGENSFRDMQLMTLCKHNIIANSSFSWWGAWLNANDDKNVICPDKWVHYTSATGVLPSEWIKIKAS V | 114 |
| Prevotella maculosa | WP_019966794.1 | 518810840 | protein [Prevotella maculosa] | 25.99 | | MKIVKIIGGLGNQMFQYALALAIALQERWKDEIKLDLHGFNGYHKHQGYQLDMLFGHRFEAATLTDVAQLA WPYPHYQLMRVGSRLLPKRRSMLCEPSKGLLPSDVLKQKGSLYYDGYWQDERYFRAIRPQIMAAPKFPDFT DRRNLETEKRLKASEAVSIHVRRGDYLDDVLFQGTCNIAYYQRAIARLCQLKTPVFCIFSNDMAWCKVHIEPL LHGKEILYVMNRGKESYRDLQLMTLCRHHIIANSSFSWWGAWLSKAEDGITIAPRHWYAHDAKPSPAAE RWIKV | 115 |
| Salmonella enterica; Salmonella enterica subsp. enterica serovar Worthington str. ATCC 9607; Salmonella enterica subsp. enterica serovar Cubana str. CFSAN002050 | YP_008261369.1 | 525860034 | fucosyltransferase [Salmonella enterica subsp. enterica serovar Cubana str. CFSAN001083; | 25.99 | | MYSCLSGGLGNQMFQYAAAYILKQYFQSTTLVLDDSYYSQPKRDTVRSLELNQFNISYDRFSPADEKEKILLL RKFKRNPFPKQISEILSIALFGKYALSDRAFYTFETIKNIDKACLFSFYQDADLLNKHKQLIPLFELRDDLLDICKN LELYSLIQRSNNTTALHIRRGDYVTNQHAAKYHGVLDISYYNHAMEYVERRGKQNFIIFSDDVRWAWKAFL ENDNCYVINNSDYDFSAIDMYLMSLCKNNIIANSTYSWWGAWLNKYEDKLVISPKQWFLGNNETSLRNAS WITL | 116 |

TABLE 1-continued

| Bacterium names | Accession No. | GI No. | Gene name [bacterium] | % identity FutC | Alias | SEQUENCE | SEQ ID NO |
|---|---|---|---|---|---|---|---|
| Salmonella enterica subsp. enterica serovar Cubana str. CFSAN002050; Salmonella enterica subsp. enterica serovar Cubana str. CVM42234 | | | | | | | |
| Bacteroides sp. 3_2_5 | WP_008659600.1 | 495935021 | protein [Bacteroides sp. 3_2_5] | 25.94 | | MKKVIPSGGLGNQMFQYAFYLFLKKKGIKAVIDNSLYSEFKMHNGFELIKVFDIKESIYRTYFLKVHLIFIKLLMK IPPVRKLSCKDDVIPIGDHEFDPPYARFYLGYWQSKKIVNYVIEELRAQFIFRNIPQMTIEKGDFLSSINSVSIHIR RGDYMGIPAYQGICNEIYYERAISFMKEHFLNPRFYVFSNDSIWAKLFLEKFDIDMEIIVTPPIYSYWDMYLMS RCRNHIIANSTFSWWAAVLNINKDKIVISPTIFKKDECIDIIFDDWVKISNI | 117 |
| Clostridium sp. CAG:510 | WP_022124550.1 | 547662453 | protein [Clostridium sp. CAG:510] | 25.86 | | MIMLQMTGGMGNQMFTYALYRSLRQKGEVCIEDFTHYDTPEKNCLQTVFHLDYRKADREVYQRLTDSEP DFLHKVKRKLTGRKEKIYQEKDAIIFEPEVFQTDDVYMIGYFQSGRYFEKAVFDLRKDFTFAWNTFPEKAKKLR EQMQAESSVSLHIRRGDYMNGKFASIYGNICTDAYYEAARYMKEHFGDCRFYLFTDDAEWGRQQESEDT VYVDASEGAGAYVDMALMSCCRHHIIANSSFSWWGAMLDENPDKTVIAPAKWLNISEGKDIYAGLCNCLI DANGSVQGE | 118 |
| Rhodopirellula europaea; Rhodopirellula europaea SH398 | WP_008665459.1 | 495940880 | glycosyl transferase family protein [Rhodopirellula europaea] | 25.86 | | MIVTRLIGGLGNQLFQYAFGHSLARSTYQTLLIDDSAFIDYRLHPLAIDHFTISASRLSDADRSRVPGKFLRTPV GRALDKVSRFVPGYQGVLPVRREKPFGRESLLARSDLYLDGYWQSEKFPPGLRGSLREEFQLREQPSETTR RLSAQMKSENSVAIHVRRGDYVTSAKAKQIYRTLDADYRRCLLDLAAHETDLKLYLFSNDVPWCESNLDVGI PFTPVQHTDGATAHEDLHLIAQCRHVVIANSTFSWWGAYLGQLHPTRRVYYPEPWPHPGTLDGSAMGCD DWISEASLEEQSSLKSSRRAA | 119 |
| uncultured bacterium | EKD23702.1 | 406873590 | glycosyl transferase family protein [uncultured bacterium] | 25.82 | | MIIVKLKGGMGNQMFQYAIGRNLATKLGTQLRLDLTFLLDRSPRKDFVFRDYDLDIFALDVAFAGPTDLKPFT QFRISHLTKIYNIFPRLLGRPYVISEPHPHFSEAILKSSDNVYLDGYWQSEKYFKEIENSIRDDFKFRQPLEGRAA EMAAQIKNEDRAVCLNVRRADFVTSKKAQEPHGFIGLDYYQKAVDLLVSKVGPLHLFIFSDDVDWCAANLK FNYPTTFVTKDYSGKKYEAYLQLMTLCRHYIIPNSTFAWWGAWLNSDPNKIVIAPKQWFKEASISTTDIIPST WIRL | 120 |
| Bacillus cereus; Bacillus cereus AH1271 | WP_000587678.1 | 446510160 | protein [Bacillus cereus] | 25.74 | | MIIVKLKGGLGNQMFQYALGKSLAYYDKPLKIDADYIKNNEGYVPRDFSLSKFNIELDLYQEADKERVGFILK NNFLAKKLRNYFLKKGKYKGKYIIENPDNLGLFKKELFENHNESMYIDGYWQSYLFNNIRECLIKEFNLKPEYT KEMTEIMQRINETNSVAVHIRRGDVVKLGWTLDTTYYKKAIAEIVNVDNPKFYVFSDDTDWVRSNLQELD NAVFIGECNLFDYQEIMLMSTCKHHNIISNSTFSWWGAWILNQNDHQVVVSPSAWINGMSVETTSLIPDSW KRV | 121 |

TABLE 1-continued

| Bacterium names | Accession No. | GI No. | Gene name | % identity FutC | Alias | SEQUENCE | SEQ ID NO |
|---|---|---|---|---|---|---|---|
| Firmicutes bacterium CAG:95 | WP_022499937.1 | 548309386 | protein [Firmicutes bacterium CAG:95] | 25.74 | | MDIIRMEGGLGNQLFQYALYRQLQFMGRTVKMDVTTEYGREHDRQQMLWAPDVHYEEATQEEINRLTD GFMDLPSRIRRKLTGRRTKKYAEADSNFDPQVLLTGYFQSEKYFKDVEGILHTELGFSDRIYDGLSEVF ADQIRNYQKQIRETESVSLHVRRGDYLEHPEIYGMSCTMEYYQAGVRYIRERHPDAEIFVTNDPVFTEKWL QENFLGDFTLIQGTSEETGYLDLMLMSQCKHQIMANSSFSWWGAWLNPNKDKIVVAPEPWFGDRNFHDI YTEEMIRSPRGEVKKHG | 122 |
| Prevotella oris; Prevotella oris F0302 | WP_004374901.1 | 490508875 | alpha-1,2-fucosyltransferase [Prevotella oris] | 25.74 | | MIAATLFGGLGNQMFIYATVCALSLHYQVPMAFNLNHGFANDYKYHRKLELCKFNCQLPTAKWITPDYRGE LNIKRISRRIGRNLLCPNYQFVIEEBPFHYEKRLFEFTNKNIFLEGVWQSPCYFENYSKEIRADFQLKVPLSKEML EEIYALKATGKTLVMLGIRRYQEVEGRDICTYKLCDEKEYYIKAITYIQERIPNALFVVFTQDKEWATTHLPKGAE FYFVKDKQDEYATVADMFLMTQCTHAIISNSTFYWWGAWLQCTTKNHVIAPDSFINSDCVCKEWIILKRNS LC | 123 |
| Escherichia coli | AAO37719.1 | 37528734 | fucosyltransferase [Escherichia coli] | 25.73 | | MYSCLSGGLGNQMFQYAAAYILQRKLKQRSLVLDDYFLDCSNRDTRRRFELNQFNICYDRLTTSEKKEISII RHVNRYRLPLFVTNSIFGVLLKKNYLPEAKFYEFLANNCKLQVKNGYCLFSYFQDATLISHRDMIPLFQINEDL LHLCNDLHIYKKVICENANTTSLHIRRGDYIITNPHASKFHGVLPMDYYEKAIRYIEDVQGEQVIIVFSDDVKWA ENTFANQPNYVVVNNSECEYSAIDMFLMSKCKNNIIANSTYSWWGAWLNTPEDKIVVSPRKWFAGNNKSK LTMDSWINL | 124 |
| Leeia oryzae | WP_018150480.1 | 516890767 | protein [Leeia oryzae] | 25.71 | | MIIVKLIGGLGNQMMQYAFAHACAKRLGVPFKLDTAFESYKLWPYGIHNFHTAPIASIEEIEHAKSMGVITE TSFRRDDSLVSAVKDGMYIQGYWADYRYSESVWGELKPVFTLMDPLTPEQQALAMNISAPNAVAIMVKR GDYVRNPNCFLLPQQYRDAIKLVLDQQPDAVIYCFSQDDWIAMLIIPAPKWRGQGIDNGFVDMIL MSKARHRIVANSTRSIWASRMDQDGLTIVPSQFRRKDDPWLLQVYGPVLQPCYPPQWRWDVTGDGKKE AEMTSTALLQIAGGDVRRKLRIGVWGFYEFYQNNYIFLNKNAPIGHELLKPFNQLYQQAHNLEFVTLDL VADLSTLDAVLFFDAPNMRSPLIVVSVMQLDIKKYLCLLECLIKPDNWQQSLHELFTRIFTWHDGIVDNMYI KYXQLMPWIESAOSLTAPFFETEAKKGYLQKKLICWISGNKLVSHPPELYSKRIEVIRWRESHHPEHFDLYG MGWSASQYPSYKGKIDDKIVLXGYRFSLCYFNAKFLPGYITEKIIDCFKAGWPVYBCGAPNIAQWIPUNCFID SGKDTDALYTYLISMTEEVHADYLENIRQRRLGGKAYPFSADAFINMTRTIVQDCLFPHERTDVSWPNY NHGNFWSAITSALNQNVSVELLVLDNASTDDSWSQLQFFADYPQVLIRNRWNIGVQHMWNHATWLAT GRYVVMLSADDLLLPGHLEQAVKHLDHNPASSIYYTPCLWINEHDQPLGTLNHPGHLESDYVGGRDCISDLL KRDSYTPSAAVIRRETLNRIGSMNLHLKGAIDWDLWIRIAEISPAFIFRKOPGVCYRQHSGNNSVDFYASTAP LEDHIRIVESIIDRKVAVKYLLKAKEEIIAHLDNRMSYPENQIQHLLSRINNIKDYLRKGAGPVISVIIPTICNRPGI IAIMAIFSIITYKDFTVVHNDGGGCDIGGIVDRFSDQLQISYVRSSQSGGAAASRNRALKLAKGRIIAYLDDD DVYLDSHLEKLVDAYKKKSFKHYINTYLIQERKEGRUELGRERRYAGISYSRAALIVSNRIPTPTWSHTKCLI DTIGDPFDESLEILEDWDFLLRASKVTEFYQVNAIIVIVKSDKSRDUHTIRANADKLLAYHQKIYAKHPVINISI LANRQSLINSLSNRQDNPKNENSYQGWVNARQPNELAVQIIJIFRMMLOWSQYQFMIVMVKQSQQ NLIANTIDSFCQQLYSGWLIVISDFSAPDESFINNEVLGMIKDPVLKPAFNLDMLRSQDYIGSSIFFRTDSIAAVG GTRLTSTALLKVGDRIILNGGACVIYTDHDYVSDUGMIKDPVLKPAFNLDMLRSQDYIGSSIFFRTDSIAAVG GFASPPGARTYEACFRMLGNYGPQTIEHLEPVMTrPENOPENSLRVAAMQLALEEHLHRNNISASIEEGYV TGFLVQYHHSEAQPRVSMIPNKDKHEFLAPCIETLMKVTQYPARCVIIVDNQSTDPDTLIYYEMESRFANNVK VIQYDNPFNFSAQCNLGAESATQDRILRLNNDTEIVCIILERMMQMAQRNDVGVVGARLVFPETVTIQH AGIVLGGKYPDEVFQFPYMNPPVDKVSLNRTKVVQNYSAVRGACLLVRKSLYQQVGGMNEQNLAVLYGD VDLCLRIRQLHKSWWTPPSTLVHHTGKRLNSNSQHHKHLMMVIQTRQEREYMLSHWLDIIANDPYYHRLL DKSECNGTIDCTHTPLMDDIPSARPRLQGMALVGGSGPYRVNIVIPFHILERSAIAIMSNFCRRSKARLPSITEL ARNAPQVFWQNALADEFIRMLCMYKKYLPSVFRIQMLDDLLTEIPDASSFKRHQKNWRDAKARLRKSLKF CDRLIVSTFPLRTFAEDMIDDIIVVPNMLERSVWGDLVSKRRAGKKPRVGWWGAQQHAGDLALMTDWKA TGHEVDWFCKGMCPDIRPVVAFVNTRWLTYDKYPQGIAALNLDLAIAPLEINAFNEAKSNLRLLEYGALG WPVICTDIYPYQTNNAPVCRVPNDASAWIEARSHIADUGATAUXILRQWVHDHYMLFDHAQFWLSA LTRPAGK | 125 |

TABLE 1-continued

| Bacterium names | Accession No. | GI No. | Gene name [bacterium] | % identity FutC | Alias | SEQUENCE | SEQ ID NO |
|---|---|---|---|---|---|---|---|
| Desulfovibrio africanus; Desulfovibrio africanus PCS | WP_005984173.1 | 492830219 | Glycosyl transferase family 11 [Desulfovibrio africanus] | 25.68 | | MFQYAAARALSLRHSASLAADLTWFSQQFDVQTTPREYALPAFRLNLPEADKRIVATFRLNPTELRIVSFLRH RICFPSRFLPRHITELSFDVWDGFRDILPPAYLDGYWQSERYFSDYPDIIRADFSMLSISEQAAWMSAKIASVQ DSISLHIRRGDYVNSLATRKAHGIDTERYYAKALEWIADRIGAATIFAFSDDPRWRANFDFGKHGIVVDGS WTAHEDMHLMSLCSHHIIANSSFSWWGAWLSTSQGITIAPKSWFSNPHIWTPDVCPATWERIPC | 126 |
| Akkermansia muciniphila CAG:154 | WP_022196965.1 | 547786341 | Glycosyl transferase family 11 [Akkermansia muciniphila CAG:154] | 25.66 | | MAKGKIIVMRLFGGLGNQLFQYAFLFALSRGGKARLETSYEHDDKRVCELHHFRVSLPIEGGPPWAFRK SRIPACLRSLFAAPKYPHFREEKRHGFDPGLAAPPRRHTYPKGYFQTEQYFLHCREQLCREFRLKTPLTPENARI LEDIRSCCSISLHIRRTDYLSNPYLSPPPLEYYLRSMAEMEGRLRAADAPQESLRYFIFSDDIEWARQNLRPALP HVHVDINDGGTGYFDLELMRNCRHHIIANSTFSWWAAWLNEHAEKIVIAPRIWFNREEGDRYHTDDALIP GSWLRI | 127 |
| Dysgonomonas mosii; Dysgonomonas mosii DSM 22836 | WP_006843524.1 | 493897667 | protein [Dysgonomonas mosii] | 25.66 | | MKIVKLQGGLGNQMFQYAIARTLETNKKDKIFLDLSFLRMNNVSTDCFTARDFELSIFPHLRAKKLNSLQEKF LLSDRVYRVKFIRKIANINFHKINQLENEIVGIPGIKNVIVLDPGYSESYFKIHFRPDLIKDFEFPELDTRNEALKKTI VNNNSVSIHIRRGDYVHLKNANTYHGVLSLEYLNCIKRIGEETKEQLSFFIFSDDPEYASKSLSFLPNMQIVD WNLGKNSWKDMALMLACKHHIIANSSFSWWGAWLSERGITYAPVKWFNNESQYNINNIIPSDWVII | 128 |
| Prevotella oris; Prevotella oris F0302 | WP_004372410.1 | 490506359 | glycosyl transferase family 11 [Prevotella oris] | 25.66 | | MDIVLIFNGLGNQMSQYAFYMSKKFVPQSKCMYYKGASNNHNGSELDKLFDIKYSETFFCKLILLLFKLYENI PRLRKYFPHILGINIVSEPQNYDYNESILKKKTRFGITLYKGGWHSEKYFLANKQDVLNTFSFKIAKEDKNFIDLAK SIEEDTNSVSLHVRRGDYLNISPTDHYQFGGVATTNYYKNAVSYMLKRNKQAHFYIFSDDITWCKAEYKDLM PTFIECNKKNKSWRDMLLMSLCTNHINANSTFSWWGAWLSTKNGITICPTEFIHNVVTRDIYPETWVQL | 129 |
| Pseudogulbenkiania ferrooxidans 2002; Pseudogulbenkiania ferrooxidans | WP_496239055 | 496239055 | glycosyl transferase family 11 [Pseudogulbenkiania ferrooxidans] | 25.66 | | MIIVRLMGGMGNQLFQYATAFALSKRKSEPLVLDTRFFDHYTLHGGYKLDHFNISARILSKEEESLYPNQWA NLLRYPIIDRAFKKMHVERQFTYQDRIYRMKRGQALLGVWQSELYFQEYRKEISAEFTLKEQSSVTAQQISV AMQGGNSVAVHIRRGDYLSNPSALRTHGICLSGYYNHAMSLLNERINDAQFYIFSDDIAWAKENIKIGKTSK NLIFIEGESVETDFWLMTQSKHHIIANSTFSWWGAWLANNTDEQLVICPSPWFDDKNLSETDLIPKSWIRLN KDLPV | 130 |
| Salmonella enterica | WP_000286641.1 | 446208786 | protein [Salmonella enterica] | 25.66 | | MYSCLSGGLGNQMFQYAAAYILKQYFQSTTLIVLDDSYYYSQPKRDTVRSLELNQFNISYDRFSFTDEKEKIKLL RKFKRNPFPKKISEILSIALPGKYALSDSAPYAVETIKNIDKACLPSFYQDADLLNKHKQLILPLFELRDDLLDICKN LDVYPLLRNNNTTALHIRRGDYLTNQHAAKYNGVLTREGKQNFIIFSDDVKNAQKAFL GNENCYIVNNGDYDYSAIDMYLMSLCKNNIIANSTYSWWGAWLNKSEDKLVISPKQWFLGNNETSLRNAS WIIL | 131 |
| Carnobacterium sp. WN1359 | YP_008718688.1 | 554649642 | glycosyl transferase family 11 [Carnobacterium sp. WN1359] | 25.59 | | MLIVKVYGGIGNQMFQYSFYKYLQKNNDDVFLDISDYKVHNHNGFELIDVFNIEVKQADMSKFKGHVSSK NSIFYRLTSKLFKRNILGYSEFMDSNGISIVRNEKILTDHYFIGFWQDVLYLQSVEEEIKEAFNFKNVAIGKQNLE LISLSBSVESVSVHIRKGDYANNSDLSDICDLEYYEEAMKIIDSKVSEPLYFIFSDDIEWCKQKPFGKRDNLIYVD WNIAKKSYIDMLLMSKCKHNIIANSTFSWWGAWLNNNSKKIVICPKTWDRRKNENHLLLNDWIAI | 132 |
| Prevotella sp. CAG:1185 | WP_021964668.1 | 547227670 | protein [Prevotella sp. CAG:1185] | 25.58 | | MMKIIVNMACCGLANRMFQYSYYLFLMHKGYNVKVDFYNSAKLAHEKVAWNDIFPKARIEQASFSDILKSG GGSDVLSKIRRKYLPLSSVVNMPTAFDANLPVENKKLQYIIGVFQNANMVEAVEDVKRCFKFQPFTDERNL KLQNEMQSCESVAIHVRKGDYAQRIWYQNTCPIEYYQNAIRLISEKVNNPKLYVFTDNPEWVKEHFKDFPY | 133 |

TABLE 1-continued

| Bacterium names | Accession No. | GI No. | Gene name [bacterium] | % identity FutC | Alias | SEQUENCE | SEQ ID NO |
|---|---|---|---|---|---|---|---|
| Selenomonas sp. CM52 | WP_009645343.1 | 497331130 | glycosyl-transferase, family 11 [Selenomonas sp. CM52] | 25.58 | | TLVEGNPASGWGSHFDMQLMSVCKHNIISNSTYSWWSAFLNVHNEKIVIGPKVWFNPDSCSEFTSERILCK DWIAV | 134 |
| Selenomonas sp. CM52 | | | | | | MFQYAMASSVARRAGEILKLDLSWIRQMEKKLSADDIYGLGIFSDEKFSTNEVQKFLPSGKFSAKIYRAVN RRMPFSWRRVLEEGGMGWHPQIMEIRRSVFYMGYWQSEKYFSDFIQEIFRKDFTFREEVRQSIEERRPIVE KIRKSDAVSLHIRRGDYAQNPALGEIFLSFTMQYYIDAARYISERVKTPVFFIFSDDIPWAKENLPLPYEVCYIDD NIQTNEREIGHKSKGYEDMYLMTQCQHNIIANSSFSWWGAWLNHNPNKIVVAPKKWCNGSFNYADIVPE QWVKL | | |
| Bacteroides nordii; Bacteroides nordii CL02T12C05 | WP_007486621.1 | 494751213 | protein [Bacteroides nordii] | 25.57 | | MEIVFIFNGLGNQMSQYALYSKRNLGCKVRYAYNIRSLSDHNGFELDRVGITYPNNLFNKCINIIYRLLFAN KYLFLVQKMIYMLRQMNVYSIKEKDNYDYDYKIILYLYYGGMHSEKYFLSNADIIKDKFRPNISKLNSES LVLYHRLSSLNAVALHVRGDYMAPEHYNVPGCVCGIEYYKAAIQYIQSQILNPVFIVFSNDIEWVKENITGIQ MIFVDFNKKENSWMDMCLMSCCEHNIISNSTFSWWGAWLNNNKNKIVVCPKYFMSNIDTKDIYPSWIKI | 135 |
| Parabacteroides merdae; Parabacteroides merdae ATCC 43184; Parabacteroides merdae CL09T00C40 | WP_005635503.1 | 491855386 | protein [Parabacteroides merdae] | 25.54 | | MKKKDIILRVWGGVGNQLFIYAFAKVLSLITDCKVTLDIRTGFANDGYKRVYRLGDFSISLLPALRFTLLSFAQ RKMPYIRHLLAYKFDFPEEDQKYPLETLDSFFKIYSDKNLYLQGWQYFDFSSYRDVLLKDLRFFVEINNTYLYY SDLIEKSNAVAIHFRRIQYEPVISIDYYKKAIKYISENVENPTFFIFSDDINWCRENLSINGICFFVENFKDELYELK LMSQCNHFIIANSTFSWWGAWLISNGAWLSVNADKKVIMPDGYTDVSMNGSIVHI | 136 |
| Butyrivibrio sp. NC2007 | WP_022768139.1 | 551024004 | protein [Butyrivibrio sp. NC2007] | 25.51 | | MIIIQLKGGLGNQMFQYALYKELKHRGRDVDKIDDESGFIGDKLRVPVLDRFGVEYDRATKDEVIALTDSKMDI FSRIRRKLTGRKTFRIDEMEGIFDPKILETENAYLVGYQWSEKYFTSPEVIEQIQEAFGKRPQEIMHDSVSWST LQQIECCESVSIHVRTDYMDAEHIKIHNLCSEKYKNAISKIREEHPNAVFFIFTDDKEWCKEHFKGPKFITVE LQEGEFTDVADMLLMSRCKHHIIANSSFSWWSAWLNDSPEKIVIAPSKWINNKKMDDIYTERMTKVAI | 137 |
| Bacteroides ovatus; Bacteroides ovatus ATCC 8483; Bacteroides ovatus CL02T12C04 | WP_004302233.1 | 490430100 | protein [Bacteroides ovatus] | 25.5 | | MIVVYSNAGLANRMFHYALYKALEVKGIDVVFDEKSYVPEWSFETTLMDVFPNIOYRESLQFKRASKKTFL DKIVIHCSNLFGGRYVNYRFKYDDKLFLFTKLETNQDLCLIGLWGSEKYFMDVRQEIQKCFQYRSFVDDKNVKT AQQMLSENSVAIHVRKGADYQONRIWKNTCTIDYYRLAIDIRMHVQNPVFVFTDNKDWVIENFTDLDY TLCDWNPTSGKQNYLDMQLMSCAKHNVIANSTYSWWGAWLNENSDKIVIAPKRWFNKIVTPDILPEQWI KI | 138 |
| Mesotoga prima MesG1.Ag.4.2; Mesotoga prima | YP_006346113.1 | 389844033 | glycosyl transferase family protein [Mesotoga prima MesG1.Ag.4.2] | 25.5 | | MRVVWFGGGLGNQMFQYGLYCFLKKNNQEVKADCTQYSTTPMNNGFELERLFNLDIAHANLDVISKLTG GNRLSPRKVIWKLFRKPKVYPEEKIPFSFDDPVLKGYWQNMNYLEPCAKELRDVFTPPAFSSDNN KRLADEIAKVEAVGHVFRRGDFLKSSNLGFGGICSDQYYLRAIQMENTVVEPVFYVFCDDPQWAKNSFSD ARFTVIDWNIGSNSYRDMQLMSLCKHNIIANSTFSWWAAWLNRNPNRTVIAPERMVNRDLDFSGIFPND WIRLQG | 139 |

TABLE 1-continued

| Bacterium names | Accession No. | GI No. | Gene name | % identity FutC | Alias | SEQUENCE | SEQ ID NO |
|---|---|---|---|---|---|---|---|
| Clostridium sp. KLE 1755 | WP_021639228.1 | 545399562 | glycosyl-transferase family 11 [Clostridium sp. KLE 1755] | 25.49 | | MIVLKLQGGLGNQMFEYAFARTIQEQKKDKKLILDTSDFQYDKQREYSLGHFILNENIEIDSSGKFNLWYDQR KNPLLKVGFKFWPKFQFQTLKFGIVWDYAKYIPVDVSKKHKNILLHGLWQSDKYFSQISEIIRKEFAVKDEP SQGNKAWLERISSANAVCVHIRRGDFLAKGSVLLTCSNSYLKAMEIISKKVNEPFFIFSDDIEDVKIPEFPG YQITLVNQSNPDYEELRLMSKCKHFIIANSTFSWWSSLLSENEDKVIVAPRLWYSDGRDTSALMRDEWIIIDN E | 140 |
| Bacteroides plebeius CAG:211 | WP_022052991.1 | 547321746 | glycosyl-transferase family 11 [Bacteroides plebeius CAG:211] | 25.42 | | MDLVTLSGGLGNQMFQFAFYWALKKRGKKVFLYKNKLAAKEHNGYETQTLFGVEEKCVDGLWMTRLLGC PLLGKILKILHPPHKIRERVLYNYSIYLPLFERNGLHWVGYWQSEKYFQDVADDIRRIFCFDHLSLNPATSAALK CMSEQVAVSVHIRRGDYYLPCNVATYGGLCTVEYYENAIRYVKEYPQAVFYVFSDDLDWVRENIPSAGKM VFVDWNRGKDSWQDMFLMSKCHHNILANSSFSWWGAWLNTHPEKLVIAPERWANCPAPDALPDGWV RIEGVSRR | 141 |
| Treponema lecithinoly-ticum; Treponema lecithinolyticum ATCC 700332 | WP_021686002.1 | 545448980 | glycosyl-transferase family 11 [Treponema lecithinoly-ticum] | 25.4 | | MAIKIVKISGGLGNQMFCYAFACALQKCGHKVYDTSLYRKATVHSGIDFCHNGLETERLFGIKFDEADTAD VRRLSTSAEGLLNRIRRKYFTKKTHYIDTVFKYPELLSDKNDCYLLEGYWQTEKYFLPIEKDIRRLFTFRPTLSEKS AAVQSALQAQQAAVLSASIHVRRGDFLNTKLNVCTETYNNAIKYAVKKHAVSRPIFSDDIPWCREHLCFC NAHAVPIDWNTGNDSWQDMALMSMCRCNIIANSSFSWWAAWLNNASDKTVLAPAIWNRRQLEYVDRY YGYDYSDIVPESWIRIPID | 142 |
| Bacteroides eggerthii; Bacteroides eggerthii DMS 20697 | WP_004291980.1 | 490419682 | glycosyl-transferase family 11 [Bacteroides eggerthii] | 25.34 | | MRLIKMTGGLGNQMFIYAFYLRMKKRHTNTRIDLSDMMHYNVHHGYEMHRVFNLPKTEFCINQPLKKVIE FLFFKKIYERKQDPSSLLPFDKKYLMPLLYFKGFYVQSWERFFADMENDIRIAFTFNSDLFNEKTQAMLTQLKHNE HAVSLHIRRGDYLEPKHWKTTGSVCQLPYYLNAITEMNKRIEQPSYVFSDDIAWVKENLPLPQAVFIDWNK GAESWQDMMLMSHCRHHIICNSTFSWWGAWLNPRENKTVIMPERWFQHCDTPNIYPDGWIKVPVN | 143 |
| Bacteroides stercoris; Bacteroides stercoris ATCC 43183 | WP_005656005.1 | 491891563 | glycosyl-transferase family 11 [Bacteroides stercoris] | 25.34 | | MRFIKMTGGLGNQMFIYAFYMRMKKHYSTRIDLSDMVHYKAHNGYEMHRVFNLPPIEFRINQPLKKVIEF LFFKKIYERKQVPSSLVPFDKKYFWPLLFKGFYQSERFFADMADDIRKAFTFNPRLSNRKTKEMSEQIDHDE NAVSIHVRRGDYLEPKYWKTTGCVCQLPYYLNAIAEMNKRISQPSYVFSDDIAWVKENPLPKAFFIDWNK GAESWQDMMLMSRCRHHIICNSTFSWWGAWLNPRENKTVIMPERWFRHCETPDICPDKWIKVPINQPD SIQ | 144 |
| Butyrivibrio proteo-clasticus; Butyrivibrio proteo-clasticus B316 | YP_003831842.1 | 302671882 | glycosyl transferase 11 [Butyrivibrio proteo-clasticus B316] | 25.34 | | MIIIQLKGGMGNQMFQYALYRQLKKLGREKIDDETGFVDDELRIPVLQRFGISYDKATREEIVKLTDSKMDI FSRIRRKLTGRKTFRIDEESGIFDPRILEVEDAYLVGYWQSDKYFANEEVEKEIREAFEKRPQEVMQDSVSWTI LQQIECCESVSLHIRRTDYIDEEHIHHNICTEKVNQYPSAVFFIFTDDKDWCRQHRFGPNFFVVD LDEDTNTDIAEMTLMSRCKHHILANSSFSWWAAWLNDNPGKIVIAPSKWINNRKMDDIYTARMKKIAI | 145 |
| Roseobacter sp. GAI101 | WP_008228724.1 | 495504071 | alpha-1,2-fucosyl-transferase [Roseobacter sp. GAI101] | 25.34 | | MSPIVHFPSDRLLRYEHLSLWKTAMIYTRLLARLGNQMFQYAAGRGLAARLGVDFTDSRRAVHKGDGV LTRVFDLDWAAPENMPPAQHERPLAYYAWRGLRRDPKIYRENGLGYNAAFETLPDNTYLGHYWQCERYFA HIADDIRAAFVPRHPMSAWNADMARRIASGPSVSLHVRRGDYLTVGAHGICDQTYDAALAAVMQGLPSP TVYVFSDDPQWAKDNLPLTFEVVVDPNGPDSDYEDMRLMSLCQHNVIANSFSWWGAWLNANPQKRV AGPANWFSNPKLSNPDILPSRWIRI | 146 |
| Thalassobacter arenae; | WP_021099615.1 | 54666256 | alpha-1,2-fucosyl- | 25.34 | | MGQDMIYSRIFGGLGNQLFQYATARAVSLRQGVELVLDTRLAPPGSHWAFGLDHFNISARIAEPSELPPSKD NFFKVVMWRAFGHDPAFMRERGLGYQSRIAQAPDGTYLHGYFQSERYFADVLDHLENELRIVTPPDTRNA | 147 |

TABLE 1-continued

| Bacterium names | Accession No. | GI No. | Gene name | % identity FutC | Alias | SEQUENCE | SEQ ID NO |
|---|---|---|---|---|---|---|---|
| Thalassobacter arenae DSM 19593 | | | transferase [Thalassobacter arenae] | | | EYADRIASAGHTVSLHVRRGDYVETSKSNSTHATCDEAYYLRALARLSEGKSDLKVFVFSDDPEWVRDNLKLP YDTTPVGHNGPDKPHEDLRLMSCCCSDHVIANSTFSWWGGWLDRRPEARVVGPAKWFNNPKLVNPDILPE | 148 |
| Prevotella oris; Prevotella oris C735 | WP_ 004374011 | 490511493 | protein [Prevotella oris] | 25.33 | | MKIIKIIGGLGNQMFQYALAVALQKKWKDEIKLDLHGFNGYHKHQGYQLDEIFGHRFKAASLKEVAQLAW PYPHYQLMRVGSRLLPKRKTMVCESADCRFQSDLLNLEGSLYYDFYWQDERYFKAPRTEIIEAFKFTPLVGDS NRKVENMLKEGRFASLLHVRRGDYLKEPLFQSTCDIAYYQRAISRLNQMADYPYCYLIFSNDIAWCKTHIEPLCD GRRTHYVDWNHGKESYRDMQLMTFCKHHIIANSSFSWWGAWLSTANDGITIAPHQWYANDRKPSPAAE AWLKL | 149 |
| Prevotella culorum; Prevotella culorum F0390 | WP_ 004380180.1 | 490514606 | protein [Prevotella culorum] | 25.33 | | MKIVRIIGGLGNQMFQYALALALKQQQENEEVKLDLSAFRGYKKHGGFQLVQCFGTTLPAATWQEVAQLA WYYPHYQLWRLGHRVLPVCKTMLKEPDNGAFLPEVLQRKGDAYYEGCWQDERYFSHYRPAILQAFTFPTF TNPRNLAMQQQINTTESVAIHVRRGDYLHDALFRNTCGLAYFQRAITCLIQHVAHPVFYVFSDDMAWCRQ HIQPLLQTNEAVFVDWNHGKASICDLHLMTLCRHHIIANSSFSWWGAWLSPHQAGWIIAPKQWYAHEEK MSPAABRWLKL | 150 |
| Spirosoma panaciterrae | WP_ 020596174.1 | 522084965 | protein [Spirosoma panaciterrae] | 25.33 | | MNRRVAVQLKGGLGNQLFQYALGRRLSLQLEAELLFDCSVLENRIPVTNFTFRSFDLDMFRIAGRVATPSDL PLFPKSASIRSPWPHLVQLARLWKQGYSVYERGFAYNPKMLRQLSDRVYLNGYWQSYRYFEDIAATLRAD CSFPDLLPDSAVGLAGQINATNSICLHIRRTDFLQVPLHQVSNADYVGRAIAYMAERVNDPHFFVFSDDIAW CQTNLRLSYPVFVPNELAGPKNSLHFRLMRYCKHFITANSTFSWWAAWWLSEPSDGKVIVTPQTWFSDSRSI DDLIPANWIRL | 151 |
| Butyrivibrio proteoclasticus; Butyrivibrio proteoclasticus B316 | YP_ 003829826.1 | 302669866 | glycosyltransferase 11 [Butyrivibrio proteoclasticus B316] | 25.26 | | MNYVEVKGGLGNQLFQYTFYKYLEKKSGHVLLHTDFFKNIDSFEEATKRKLGLDRPDCDFVAVSFPISCEKL VKESDYKDSMLSQDEVFYSGVWQNKRFFLEVMDDIRKDLLLKDENIQDEVKELAKELRAVDSVAIHRFFGDY LSEQNKKIFTSLSVDYYQKAIAQLAERNGADLKGYIFTDEPYEYVSGIIDQLGSIDIKLMPVREDYEDLYLMSCAR HHIIANSSFSWWGAALGDTESGITIAPAKWYVDGRTPDLYLRNSWISI | 152 |
| Butyrivibrio sp. XPD2006 | WP_ 022765786.1 | 551021623 | protein [Butyrivibrio sp. XPD2006] | 25.26 | | MIIIQLKGGLGNQMFQYALYKELKHRGREVKIDDVSGFVNDKLRVPVLDRPGVEYERATREEVVELTDSRMD IFSRIRRKLTGRKTYRIDEMEGIFDPAILETENAYLVGYWQSEKYFTSPEVIEQIOEAFGKRPQEIMHDSVSWST LQQIECCESVSIHVRRTDYVDAEHIKIHNLCSEKYKNAIGKIREDHPNAVFFIFTDDKEWCKDHFKGPNFITVE LQEGEFTDVADMLLMSRCKHHIIANSSFSWWSAWLNDSPEKMVIAPSKWINNKMDDIYTERMTRVAI | 153 |
| Bacteroides sp. 1_1_6 | WP_ 008766093.1 | 496041586 | protein [Bacteroides sp. 1_1_6] | 25.24 | | MKIVNITGGLGNQMFQYAFAMALKYRNPQEEVFDIQHYNTIFFKFKGINLHNGYEIDKVFPKAKLPVAGV RQLMKFPSYWIPNYISRLGRKFLPIRKKEYIPPSYMNYSDEKALNWKGDGYFEGYWQSYNHFGDIKEELQK VYAHPKPNQYNAALISNLESCNSVGIHVRRGDYLAEFEFRGICGLDYYEKGIKEILSDEKKYVFFIFNDMQWC QENIAPLVGDNRIVFISGNKGKDSCWDMFLMTHCKDLIIANSSFSWWGAFLNKKVDRVICPKPWLNRDCNI DIYNPSWILCPCYSEDW | 153 |
| Bacteroides fragilis; Bacteroides fragilis YCH46 | YP_ 099857.1 | 53713865 | alpha-1,2-fucosyltransferase [Bacteroides fragilis YCH46] | 25.17 | | MKIVTFQGGLGNQLFQYVFVWLDMRCDKDNIYGYYPKKGLRAHNGLEIEKVFEVKLPNSSLSTDLIVKSIKLI NKIFKNRQYISTDGRLDVNGVLFEGFWQDKYFWEDVDILNFRWPLKLDVTNSFIMTKIQANNSISIHIRRG DYLLPKYRNIYGDICNEEYYQKAIEYILKCVDDPPFVFSDDIDWAKSIINVSNVTFVNNKGKDSYIDMPFLMS LCHHNIIANSTFSWWAAQLNKHSDKIMIAPIRWFKSLFKDPNIFTESWIRI | 154 |

TABLE 1-continued

| Bacterium names | Accession No. | GI No. | Gene name [bacterium] | % identity FutC | Alias | SEQUENCE | SEQ ID NO |
|---|---|---|---|---|---|---|---|
| Bacteroides sp. 9_1_42FAA | WP_022477844.1 | 548260617 | alpha-1,2-fucosyl-transferase [Bacteroides sp. 9_1_42FAA] | 25.17 | | MKIVSFSGGLGNQLFQYLLVVYLRECGHQVYGYYNRKWLIGHNGLEVNVFDIYLPKTNFIVNALVKVRVL RCLGFKKYVATDTYNNPIAIFYDGYWQDQKYFNIIDSKLSPKKFDLSAENSILSKIKSNISVALHIRCGDYLSSS NVEIYGGVCTKEYYEKALELVCKIKNVMFFVFSDDIEYAKLLLNLPNAIYVNANVGNSSFIDMYLMANCKVNV IANSTFSYWAARLNQDNILITIYPKKWYNSKYAVPDIFPSEWVGV | 155 |
| [Coraliomargarita sp. CAG:312] | WP_022477844.1 | 548260617 | glycosyl-transferase family 11 [Coraliomargarita sp. CAG:312] | 25.17 | | MIIVKVQGGLGNQMFQYAFGRALSEKHSQDLYLDCSEYLRPSCKREYGLDHFNIRAKKASCDVKSMVTPH FALRKKLKKIFAVPYSLSPTHILERNFNFQPSILEFNCGYFDGFWQTQKYFSGISDIVRKDTFKDAVKYSGGET FAKITSLNSVSLHIRRGDYYKVKRTRKRFSVIRAGYFKRAVEYMSKLDTPHFFIFTDDPKWVSENFPAGEDYT LVSSSGMYEDLFLMAQCRHNIIFNSSFSWWGAWLNGNPGKIVVAPDMWFTPHYKLDYSDVVPEEWIKLN TGYFESKEF | 156 |
| Pseudorhodobacter ferrugineus | WP_022705649.1 | 550957292 | alpha-1,2-fucosyl-transferase [Pseudorhodobacter ferrugineus] | 25.17 | | MIVMQIKGGLGNQMFQYAAGRALSLQTGMPLHLDLRYYRREHGYGLGAPNIEASPLDESLLPLPRESPL AWLIWLGRRGPNLVRENGMGFNPTLSNVTKPAWITGYFQSERYFAAHAATIRAELTPVAAPDLVNARWL AEIAAEPRAVSLHVRRGDYVRDAKAAAKHGSCTPAYYERALAHITARMGTAPVVVAFSDDPAWVRENLRLP AEIRVPGHNDTAGNVEDLRLMSACRHHIVANSSFSWWGAWLNPRADKIVASPARWFADPAFTNPDIWPE AWARIEG | 157 |
| Escherichia coli; Escherichia coli O127:H6 str. E2348/69 | YP_002329683.1 | 215487252 | fucosyl-transferase [Escherichia coli O127:H6 str. E2348/69] | 25.16 | | MMYCCLSGGLGNQMFQYAAAYILKQHFPDTILVLDDSYYFNQPQKDTIRHLELDQFKIIFDFRFSSKDEKVKIN RLRKHKKIPLLNSFLQFTAIKLCNKYLSNDSAYYNPESIKNIDVACLFSFYQDSKLLNEHRDLILPLFEIRDDLRVL CHNLQIYSLITDSKNITSIHVRRGDYVNNKHAAKFHGTLSMDYYISAMEYIESECCGSQTFIIFTDDVIWAKEKFS KYSNCLVADADENKFSVIDMYLMSLCNNNIIANSTYSWWGAWLNRSEDKLVIAPKQWYISGNECKLKNEN WIAM | 158 |
| Lachnospiraceae bacterium 3_1_57FAA_CT1 | WP_016359991.1 | 511537894 | protein [Lachnospiraceae bacterium 3_1_57FAA_CT1] | 25.16 | | MIIIKVMGLGNQMQQYALYEKFKSIGKNKVKLDISWFEDSSVQBKVFARRSLELRQFKDLQFDTCSAEBKEA LLGKSGILGKLERKLIPARNHFYESDIYHSEVFNMSDAYLEGHWACEKYHDIMPLLQEKIQFPESANSQNIT VKKRMCAENSVSIHIRRGDYLDPENEAMFGGICTNSYYKAAEEYIKSRVPDTHFYLFSDDTAYLRENYHGDEY TIVDWNKGEDSFYDMELMSCCRHNICANSTPSFWGARLNRTPDKIVIPAKHKNSQEIEPQLLHELWDNW VIIDGDGRIV | 159 |
| Butyrivibrio fibrisolvens | WP_022755397.1 | 551010878 | glycosyl-transferase [Butyrivibrio fibrisolvens] | 25.09 | | MKPLVSLIVPVLNVEKYLEQCLTSISSQTYDNFPEVILVVGKCIDNSENICKKWCEKDHRFIEPQLKSCLGYARN VGIDAAKGEYIAFCDSDDCIITSDFLSCFVDTALKNSSDIVETQFTLCDQNLSPIYDYDRNILGHILGHGFLEYTSA PSVWKYFVKRDIFTSNNLHYPEIRFGEDISMYLSLFSYCNLIDYVEKPTYLYRQYPSSLMNNPQGKRKYESLF DIIDFVTNEFKTRLLFQKSWLKLLFQLEMHSASIISDSATSDDEAISMRQEISGYLKKVFPVKNTIFEVTALGWG GEIVSSIASKPNTLHGVSSSNMFNYFFELLEDSTRKKLEEMIINFSPDIFLIDLISEADYLSSYKGNLGTFVKNW KIGFSIGMKMIQTHSNNSSIFFLLENYMQQAPDHVDNTNEILKMLYDDIKINHPDIICISPAPDILNRSSEPELPCI YQLKLVSDKLHTMYSPVINCVETKGLGNQLFQYVSKYIEKMTGYRPLLHIGFFDYVKAIPGGTKRIFSLDKLF PDIETTSGKIPCSHVVEEKSPISNPGSDIFYRGYWQDIRYFSDVKDEVLESFNVDTSSMSKDVIDFADTIRNANS IAMHIRRQDYLNENNVSLFEQLSIDYYKSAVDMIRKEYADDLVLFIFSSDDPEYANSIADSFDIEGFVMPLHKDY EDLYLITLAHHHIIANSTFSLMGALLSARKDGIRIAPRNWFKGTPATNLYPDKMLIL | 160 |
| Anaeromusa acidaminophila | WP_018702959.1 | 517532751 | protein [Anaeromusa acidaminophila] | 25.08 | | MFCVRIYGGLGNQMFQYALGRAMAKHYSETAAFDLSWYEQKIKPGFEASVCQYNIELSRKDRPKAWYEPIL KRISRHTDKLEMWFGLFFFEKKYHTDSTVFERGLCKKNITLDGYWQSYKYFSAIEDDLRRELTIPKEREELIAISRS LPENSVSIHVRRGDYVSNPKANAMHGTCSWEYYQAAIEKMTGLVKEPQYWFSDDITWTKENLPLPNAMYI GRELGLFDYEELILMSRCKHNIMANSTFSWWGASLNSNPNKVVIAPRKWFRHKKIKVNDLFPSSWVVL | 161 |

TABLE 1-continued

| Bacterium names | Accession No. | GI No. | Gene name [bacterium] | % identity FutC | Alias | SEQUENCE | SEQ ID NO |
|---|---|---|---|---|---|---|---|
| Bacteroides sp. 2_1_16 | WP_008768986.1 | 496044479 | glycosyl transferase family 11 [Bacteroides sp. 2_1_16] | 25.08 | | MDIVIFNGLGNQMSQYAFYLAKKKDNLNCHVIFDPKSTNVHNGAELKRVFGIELNRNYLDKIISYFYGYIFN KRIVNKLFSLVGIRMIYEPKNYDYFEELLKPSSNFISFYWGGWHSEKYFKDIELEVKKVFKPPEVTNSPYFTEWF NKIFLDNNSVSIHIRRGDYLDKPSDPYYQFNGVCTIDYYEKAILYLKERIIEPNFYIFSNDINWCMKTFGTENMY YVDCNKGKDSWRDMYLMSECRHHINANSTFSWWAAWLSPYSNGIVLHPKYFIKDIETKDYYPQKWIMIE | 162 |
| Chlorobium phaeobacteroides; Chlorobium phaeobacteroides BS1 | YP_001960319.1 | 189500849 | glycosyl transferase family protein [Chlorobium phaeobacteroides BS1] | 25.08 | | MDKVVVHLTGGLGNQMFQYALGRSISINRNCPLLLNTSFYDTYDKFSCGLSRYNVKAEFIKKNSYNNKYYRY VIRLLSRYGVACYFGSYYEKKIFSYDEKVYKRSCVSYVGTWQSYGYFDSIRDILLRDYEMVGCLEEVEKVSDIK RVDSVSLHIRRGDYFDNKRLQSIHGLLTMEYYYKAMSLFPDSSVFVFSDDIEWRENLITNTNIVYVVLESDN PENEIYLMSLCKNNIISNSTFSWWGAWLNKNKYKKVIAPRMWYKDNQSSSDLMPSDWCLI | 163 |
| Treponema bryantii | WP_022932606.1 | 551312724 | protein [Treponema bryantii] | 25.08 | | MIVISMGGGLGNQMFEYAFYTQLKHLYPKSEIKVDTKYAPPYSHNGIEVFKIFGLNPPEANWKEVHSLVKTYP IEGNKAHFIKFLYRILRKANLVEREPTSFCKQKDFTEFYNSFFELPQNNKSFYLYGPFVNYNYFAAIHNEIMDLYT FPEITDVTNIEYKRKIESSHSISIHIRRGDYITEGVPLVPDAYTREALVVINKKIEDPHFFVFTDDKDYCKSLFSDN QNFTIVEGNTGANSFRDMQLMSLCKHNIIANSTFSWGAFLNKNSEKIVIAPNIAPKDCSCPYICPDWIIL | 164 |
| Bacteroides fragilis; Bacteroides fragilis 638R | YP_005110943.1 | 675358171 | LPS biosynthesis alpha-1,2-fucosyl-transferase [Bacteroides fragilis 638R] | 25 | | MVIAKLFGGLGNQMFIYAAAKGIAQISNQKLTFDIYTGFEDDSRFRRVYELKQFNLSVQESRRWMSFRYPLG RILRKISRKIGFCIPLVNFKPIVEKKPYHFQNEIMRIASFSSIYLEGYFQSYKYFSKIEAQIREDFKFTKEVIGSVEK ASFITNNSRYITPVAIGVRRYSEMKGEFGELAVVEHDYDAAIKYIANKVPNLIFIVFSEDIDWVKKNLKLDYPVYF VTSKKGELAAIQDMYLMSLCNHHIISNSSFYWWGAYLASTNNHIVIAPSVFLNKDCTPIDWVII | 165 |
| Firmicutes bacterium CAG:534 | WP_022352105.1 | 547951298 | protein [Firmicutes bacterium CAG:534] | 25 | | MSGGLGNQMFYALYMKLTAMGREVKFPDDINEYRGBEKAWPIMLAVFGIEYPRATWDEIVAFTDGSMDFS KRLKRLFRGRHPIEVVEQGFYDPKVLSFENMYLKGSFQSQRYFEDILEEVQETFRFPELKDMNLPAPLYETTEK YLLRIEGCNAVGLHMYRGDSRSNEELYDGICTEKYYEGAVRFIQDKCPDAKFFIFSNEPKWVKGNVISLMKS QIREDMSREEIRALEDHFVLIENNTEYTGYLDMFLMSRCRHNIISNSSFSWWAFINENPDKLVTAPSRWVN GVPSEDVYVKGMTLLIDEKGRVERTIKE | 166 |
| Bacteroides fragilis; Bacteroides fragilis 638R | WP_022368748.1 | 547971670 | glycosyl transferase family 11 [Firmicutes bacterium CAG:882] | 25 | | MVIVKIGDGLGNQMFNVVCGYSVAKHDNDTILLLDTSDVDNSTLRTYLDLKPNIDFTDRESPTNKGPFHKVVK RLRRSLKYNVIYESRTENCPCVLDVYRKFIRDGYLFQNLCYFKTCKEDIMRQFTPKEPFSAKADELLHRFA TENTCSVHVRGGDIKPLSIKYYKDALDKIGEAKKDMRFIVFSNVRNLAEEYIKELGVDAEFIWDLGEFTDIEELF LMKACRRHILSDSTFSRWAALLDEKSEEVVPFSPDADKIYMPEWIMEEYDGNEEKR | 167 |
| Vibrio parahaemolyticus; Vibrio parahaemolyticus 10329; Vibrio | WP_005496882.1 | 491639353 | glycosyl transferase family 11 [Vibrio parahaemolyticus] | 25 | | MVIVKVSGGLGNQLFQYAIGCAISNRLSCELLLDTSFYPKQSLRKYELDKFNIKAKVATQKEVFSCGGDDLLS RFLRKLNLSSLFFPNVIKEKESLVYLAEISHCKSGSFLDGYWQNPQYFSDIKDELVKQIVPIMPLSSPALEWQNII INTKNCVSLHVRRGDVVNNAHTNSVHGVCDLSYREAITNIHETVEKPKPFVFSDDISWCKDNLGSLGHFTYV DNTLSAIDDLMLMSFCEHHIIANSTFSWWGAMLNDHGITIAPKRWFSSVERNNKDLFPEKWLIL | 168 |

TABLE 1-continued

| Bacterium names | Accession No. | GI No. | Gene name [bacterium] | % i-dentity FutC | Alias | SEQUENCE | SEQ ID NO |
|---|---|---|---|---|---|---|---|
| parahae-molyticus; 10296; Vibrio parahae-molyticus; 12310; Vibrio parahae-molyticus; 10290 | | | | | | | |
| Herba-spirillum frisingense; Herba-spirillum frisingense; GSF30 | WP_006463714.1 | 493509348 | glycosyl-transferase family protein [Herba-spirillum frisingense] | 24.92 | | MIVSRLIGGLGNQMFQYAAGRALALRRGVPFAIDSRAFADYKTHAFGMQCFCADQTEAPSRLLPNPPAEGR LQRLRRFLPNPLRVVTEKIFTFDEAVLSLPDGIYILDGYWQSEKYFADFADDIRKDFAVKAAPSAPNQAWLEL IGRTHSVSLHIRRGDYDVSNAAAANHGTCDLGYYERAVAHLHQVTGQAPELFVFSDLDWVATNLQLPYT MHLVRDNDAATNFEDLRLMTACRHHIVANSSFSWWGAWLDGRSESITIAPARWFVADTPDARDLVPQR WVRL | 169 |
| Rhizobium sp. CF080 | WP_007759661.1 | 495034125 | Glycosyl-transferase family 11 [Rhizobium sp. CF080] | 24.92 | | MIITRILGGLGNQMFQYAAGRALAIANEAELKLDLIEMGAYKLRPFALDQFNIKAAIAQPDEVPAKPKRGLLR KFTSAFKPDRSSCERIVENGLTFDSRVPALRGSLHLSGYWQSEQYFASSADAIRSDFSLKSPLGPARQDVLARI GAATTPVSIHVRRGDYVTNPSANAVHGTCEPPWYHEAMRRMLDRAGDASFFVFSDEPQWARDNLQSSRP MVFIEPQNNGRDGEDMHLMAACHAHIIANSSFSWWGAWLNPRPNKHVIAPRQWFRAPDKDDRIVPA TWERL | 170 |
| Verrucomicro-bium spinosum | WP_009959380.1 | 497645196 | glycosyl-transferase family 11 [Verrucomicro-bium spinosum] | 24.85 | | MVISHISEGLGNQMFQYAAGRRLSYHLGTTLKLDDYHYRLHPFRSFQLDRFLITSPIATDAEISHLCPLEGLAR AIRARLPKGKLRGATLRLLGNLGLGSPYQPRLHSFKETPKQPLLIGKVVSERHFHFDPDVLECPDNVCLVGYW QDERYFGEIRDILLRELTLKSPPAGATKAVLERIQRSSVSLHVRRGDKTKSSSYHCTSLEYCLAAMSEMRARL QAPTPFVFSDDWDWVREQIPCSSSVIHVDHNRAEDVSEDFRLMKSCDHHIIASSSLSWWAAWLGTNENSF VSPPADRWLNFSNHFTADVLPPHWIQLDGSSLLPAQ | 171 |
| Fibrella aestuarina; Fibrella aestuarina BUZ 2 | YP_007319049.1 | 436833833 | glycosyl-transferase family 11 [Fibrella aestuarina BUZ 2] | 24.83 | | MTANRVLVNSPMVIAKITSGLGNQLFQYALGRHLALQGNTSLWFDLRFHQEYATDTPRKFKLDRFNVRYN LLDSSPWLYASKATRILPGRSLRPLIDTRFEADFHFDPTVIRPAAPLTILWGFWQSEDKYFAQSTPQIRQELTFN RPLSDTFVGYQQOIEQAEVPISVHVRRGDYVTHPEFSQSFGFVGLAYYQKALAHLQDLFPNATLFFFSDDPD WVRANIVTEQPHVFVQNSGPDADVDDLQLMSLCHHVIANSSFSWWGAWLNPRPDKVVIGPQRWFAN KPWDTKDLLPSGWLRL | 172 |
| Rhodobacter sp. CACIA14H1 | WP_023665745.1 | 563380195 | alpha-1,2-fucosyl-transferase [Rhodobacter sp. CACIA14H1] | 24.83 | | MIHMRLVGGLGNQLFQYACGRAVALRHGETIVLDTRELSRGAAHAVFGLDHFAIRARMGASADLPPRSR VLAYGLMVRAGFMAPRFLREERGLGVNPAVLAAGDGTYLHGYFQSEAYFRDVVPQIRPELEIVTPSDDNLRW ASRIAGDDRAVSLHVRRGDYVASAKGQQVHGTCDADYYARAVAAIRARAGIDPRLYVFSDDPHWARDNLA LDAETVVLDHNPPGAAVEDMRLMGVCRHHIANSSFSWWGAWRNPSAGKVVVAPVRWFADPKLHNPDI CPPEWLRV | 173 |
| Rhodo-pirellula baltica SH 1; Rhodo- | NP_868779.1 | 32475785 | fucosyl-transferase [Rhodo- | 24.83 | | MATSAHLHLSDEKQTLDSKASDRDCATTEASASDKTCTISLSGGLGNQMLQYAAGRALSIHHDCLSQLDLKF YSSKRHRSYELDAFPIQAHRSIKPSFFSQILSKIQSESKHVPTYQEQSKRFDPAFFNTEPPVKIRGYFFSEKYFSPY ADQIRTELTPPIPDQPADRMAIRLKECVSTLHVRRGDYVTNANARQRFWCCTSEYFEAAIERLPTDSTVFV | 174 |

TABLE 1-continued

| Bacterium names | Accession No. | GI No. | Gene name [bacterium] | % identity FutC | Alias | SEQUENCE | SEQ ID NO |
|---|---|---|---|---|---|---|---|
| Rhodopirellula baltica | WP_020604054.1 | | pirellula baltica SH 1] | | | FSDDIEWAKQNIRSSRTTVVNDELKKAGSPETGLRDLWLMTHAKSHIIANSSFSWWGAWLANSEANLTIA PKKWFNDPEIDDSDIVPSSWHRI | |
| Spirosoma spitsbergense | WP_020604054.1 | 522092845 | protein [Spirosoma spitsbergense] | 24.76 | | MVVVELMGGLGNQMFQYAFGMQLAHQRQDTLTVSTFLLSNKLLANLRNYTYRPFELCIFGIDKPKASPFNL LRALLPFDLNTSLLRETDDPEAVIPAASARIVCVGYWQSEHYFEEVTVHVREKFIFRQPNSFTSRLANNLNGI PNSVFVHIRRGDYVTNKGANAHHGLCDRTYYERAVTFMREHLENPLFFIFSDDLEWSQELGPILEPATYVG GNQKNDSWQDMYLMSLCRHAIVANSSFSWWGAWLSPHASKIVVAPKEWFGKPLLPVKTNDLIPSNWIRI | 175 |
| uncultured bacterium | EKD71402.1 | 406938106 | protein ACD 46C00193 G0003 [uncultured bacterium] | 24.76 | | MNAIIPRITGGIGNQLFIYAAARRMAIANSMNLVIDDTSGFKYDVLYKRFYQLEKFNITSRMATPTERLPFSK IRRYLKRKINKTYPFAQRAYITQEKSGFDPRLLVHRPKGNVLDGYWQSENYFKDIEGIIRQDLLIKSPSDSLNIA TAERIKNTLAIAVHVRFFDMVDISDSSNCQSNYYHTAIAKMEEKIPNAHYPIFSDKPVLARLAMPLPDDRITIID HNIGDMNAYADLWLMSLCKHFVIANSTFSWWGAWLSDNKEKIVIAPDITITSGVTQWGFDGLIPDEWIKL | 176 |
| Prevotella micans; Prevotella micans F0438 | WP_006950883.1 | 494008437 | protein [Prevotella micans] | 24.75 | | MDVIVIFNGLGNQMSQYAFYLEKRLRNRQTTYFVLNPRSTYELERLFGIPYRSNLMCRMIYKLLDKAYFSNHI RLKKILRTALNAVGIRLIVEPITRNYSLSNFTHHPGLTFYRGGWHSELNFTSVVTBLRRKFIFPPSDDEEFKRISAL IIRTQSISLHIRRGDYLDYSEYQGVCTEEYYERAIEYIRSHVENPVFFVSDDKEYAINKFSGDDSFRIVDFNTGE NSWRDMQLMSLCRHHILANSTFSWWGAWLDSAPEKIVLHPIYHMRDVPTRDFYPHNWIGISGE | 177 |
| Thermosynechococcus sp. NK55 | AHB87954.1 | 564737556 | alpha-1,2-fucosyl-transferase [Thermosynechococcus sp. NK55] | 24.75 | | MIIVRLYGGLGNQMFQYAAGLALSLRHAVPLRFDLDMFDGVRLHQGLELHRVFDLDLPRAAPSEMRQVLG SFSHPLVRRLLVRRRLRWLLPQGYALEPHFHYWPGFEALGKPAYLDGYWQSERYFSEYQDAVRAAPRFAQP LDERNRQIVEEMAACESVSLHVRRGDFVQDPVVRRVHGVDLSAYYPRAVALLMERMERPRYFVSDDPD WVRANLKLPAPMIVIDHNRGEHSFRDMQLMSACRHHILANSSFSWWGAWLNSQPHKLVIAPKRWFNVD DFDTRDLYCSGWTVL | 178 |
| Coleofasciculus chthonoplastes; Coleofasciculus chthonoplastes PCC 7420 | WP_006100814.1 | 493031416 | Glycosyl-transferase family 11 [Coleofasciculus chthonoplastes] | 24.73 | | MLSLNKNFLFVHIPKSCILKEVYIMISFPNLGKGVRLGNOMFQYAFLRSTARRLGVKFYCPAWSGDSLFTLN DQEERVSQPEGITKQYTRQGLNPGFSENALSIQDGTEISGYFQSDKYYDNPDLVRQWFSLKEEKIASIRDRFSRL NFANSVGMHLRPGDVVGQLKRPPMRRSYYKALSYIPNQELILVFSDEPERTKKMLDGLSGNFLFLSGHKNY EDLYLMTKCQHFICSYSTFSWWGAWLGGERRTVIYPKEGQYRPGYGRKAEGVSCESWIEVQSLRGFLDDY RLVSRLEKRLPKSLMNFFY | 179 |
| Bacteroides gallinarum | WP_018666797.1 | 517492220 | glycosyl-transferase [Bacteroides gallinarum] | 24.66 | | MRLIKMTGGLGNQMFIYAFYLRMKKRHTNTRIDLSDMHYNVHHGYEMHHVFNLPKTEFCINQPLKKVIE FLFFKKIYERKQDSSNLLPDKKYFWPLLYFKGFYQSERFFADMENDIRKAFTFNSGLFNEKTQTMLKQIEHNE HAVSLHVRRGDYLEPKHWKTTGSVCQLPYYINAIAEMNRRIEQPFYVFSDDIAWVKENLPLPQAVFIDMN KGVESWQDMMLMSHCRHHIICNSTFTWWGAWLNPKENKTVIMPERFQHCETPNIYPAGWIKVPIN | 180 |
| Firmicutes bacterium CAG:882 | WP_022367483.1 | 547967507 | glycosyl-transferase GT11 family [Firmicutes bacterium CAG:882] | 24.66 | | MNNVELMGGLGKQLFQYAFSRYLQKLGVKNVLRKDFFTIQPPENNGITKREVFLDKYNTRYVAAAGEKTYR DYCDENDYRDDYAIGSDEVLYEGYMQNIDFYNVVRKEMQEBLKLKPEFIDNSMAAVEKDMSSCNSVALHIR RSDYLTQVNAQIFEQLTQDYYASAVSIIEQYTHEKPVLYIFSDDPEYAAENMKDFMGCRTVIMPPCEPYQDM YLMTRAKHNIIANSTFSWWGATLNANPDNITVAPSRMMKGRTVNLIYHKDWITL | 181 |

TABLE 1-continued

| Bacterium names | Accession No. | GI No. | Gene name [bacterium] | % i-dentity FutC | Alias | SEQUENCE | SEQ ID NO |
|---|---|---|---|---|---|---|---|
| Bacteroides xylanisolvens; Bacteroides xylanisolvens CL03T12C04 | WP_008021494.1 | 494296741 | protein [Bacteroides xylanisolvens] | 24.6 | | MIAVNVAGLANQMFHYAFGFGLMAKGLDVCFDQSNFKPRSQWAFELVRLQDAFPSIDIKVMPEGHFK WVFPSLPRNGLERRFQEFMKKMHNFIGDEVVIDEPMYGYVDMEKCATRNCIYKGFWQSEKYFRHCEDDI RKTFTFPLFDELKNIEVAAKMSQENSVAIHLRKGDDYMQSELMGKGLCTVDYYMKAIDYMRKHINNPHFY VFTDNPCWVKDNLPEFEYIIVDWNEVSGKRNFRDMQLMSCAKHNIIGNSTYSWWAWLNANQDKIVVG PKRFFNPINSFFSTCDIMCEDWISL | 182 |
| Geobacter sp. M18 | YP_004197726.1 | 322418503 | glycosyl-transferase family protein [Geobacter sp. M18] | 24.58 | | MIGMVIFRAYNGLGNQMFQYALGRHLALLNEAELKIDTTAPADDPLREYELHRLKVQGSIATPDEIAFFREM ENTHPQAYLRLTQKSRLFDPAILSARGNIYLHGFWQTEKYFADIREILLDEFEPIVPAGEDSIKVLSHMKATNA VALHVRRSDYVSNPMTLRHHGVLPLDYYREAVRRIAGMVPDPVFFIFSDDPQWAKDNIRLEYPAFCVDAHD ASNGHEDLRLMRNCKHFIIANSSFSWWGAWLSQNTGKKVVAPLKWFAKPEIDTRDIVPLQMFRI | 183 |
| Ruegeria pomeroyi DSS-3 | YP_168587.1 | 56698215 | alpha-1,2-fucosyl-transferase [Ruegeria pomeroyi DSS-3] | 24.57 | | MITTRLHGRLGNQMFQYAAARGLAARLGTQVALDTRLAESRGEGVLTRVFDLDLAQPDQLPPLKGDGLLR HGAWRLLGLAPRFRRRHGLGVNAAIETWDDGTYLHGYWQSERYFAHIAARIRADFAPFAFSNSQNAEMAA RIGDTDAISLHVRRGDYVALAAHTLCDQRYYAAALTRLLEGVAGDPVVYLFSDDPAWARDNLALPVQKVVV DFNGPETDFEDMRLMSLCRHNIIGNSSFSWWAAWLNAHPGKRIAAPASWFGDAKLHNPDLLPPDWLKIE V | 184 |
| Lachno-spiraceae bacterium 28-4 | WP_016291997.1 | 511037973 | protein [Lachno-spiraceae bacterium 28-4] | 24.52 | | MIIIQLAGGLGNQMQQYAMYQKLLSGKKVKLDISWFEEKNRQKNVYARRELELNYFKKAEYEACTEEERKA LVGEGGFAGKIKGKLFPGTRKIFRETEMYHPEIFDFEDRYLYGYFACEKYADIMEILQEQFVFPPSGNPENQK MAERIADGESVSLHIRRGDYLDAENMAMFGNICTEEYYAGAIREMKKIYPSAHFFVSDDIPYAKETYSGEEF TVVDINRGKDSFFDIWLMSGCRHNICANSTFSWGARLNRNKGKVVMRPFIHKNSQKFEPLMHELWKG WVFIDNRGNIC | 185 |
| Prevotella sp. CAG:1092 | WP_021989703.1 | 547254188 | glycosyl-transferase family 11 [Prevotella sp. CAG:1092] | 24.49 | | MRILVFTGGLGNQMFEYAFYKHLKSCFPKESFYGHYGVKLKEHYGLEINKWFDVTLPPAKWTLPPVGLFYL YKKLVPNSKWLDLFQREWKHKDAKVFFPPFKTKQYFPKENGWLKMKVDEASLCEKNKKLLQVIHDEETDCFV HVRRGDYLASNFPKSIFEGCCTLDYYKRALEYMNKNNPKVRFICFSDDLEWMRKNLPMDDSAIYVDWNTGT DSPLDMYMMSQCDNGIIANSSFSYWGAYLGGKKTTVIYPQKWWNMEGGNPNIFMDEWLGM | 186 |
| Spirosoma luteum | WP_018618567.1 | 517447743 | protein [Spirosoma luteum] | 24.41 | | MVISVLSGGLGNQLFQYAFGLKLAALQLQTELRLRERHLLESKAIARLRQYTPRTYELDTFGVEAPAASLMDTVS CLSRVASLDKTALLLRESTLTPNAINNLNNRVRDVVCLGYWQSEYFRPATEQLRKHLVFRKNPAQSRSMAD TILSCQNAAFVHIRRGDYVTNTHANQHHGLCDVSYYRRACEYVKECIPDVQFFVFSDDPWAKRELGIHLQP ARFIDHNRGADSWQDMYLMSLCRHAIVANSSFSWWGAWLNPVAERLVAPGQWFVNQPVLSQQIIPPH WHCL | 187 |
| Marinomonas posidonica IVIA-Po-181; Marinomonas posidonica | YP_004480472.1 | 333906886 | glycosyl-transferase family protein [Marinomonas posidonica IVIA-Po-181] | 24.34 | | MIIVDLSGGLGNQMFQYACARSLSIELNLPLKVVYGSLASQTVHNGVELNRVFGLDLEFATENDMQKNLGFF LSKPILRKIFSKKPLNNLKFQNFFPENSFNYSSLFSYIKDSGFLQGYWQTEKYFLNHKSQILKDFCFVNMDDE TNISIANDIQSGHSISIHVRRGDYLTNLKAKAIHGHCSLDYYLKAIEFLQBKIGESRLFIFSDDPEWVSENIATRPS DVSVIQHNRGVKSFNDMRLMSMCDHHIIANSSFSWWGAWLNPSQNKKIIAPKNWFVTDKMNTIDLIPSS WILK | 188 |

TABLE 1-continued

| Bacterium names | Accession No. | GI No. | Gene name [bacterium] | % identity FutC | Alias | SEQUENCE | SEQ ID NO |
|---|---|---|---|---|---|---|---|
| Bacteroides; Bacteroides sp. 4_3_47FAA; Bacteroides sp. 3_1_40A; Bacteroides dorei 5_1_36/D4; Bacteroides vulgatus PC510; Bacteroides dorei CL03T12C01; Bacteroides vulgatus dnLKV7 | WP_005839979.1 | 492425792 | glycosyl-transferase family 11 [Bacteroides] | 24.32 | | MKIVFKGGLGNQLFQYAFYKLSRKDETFYFYNDAWYNVSHNGFELDKYFKTDLKKCSRFWIILFKTILSKI YHWKIVVGSVEYQYPNHLFQAGYFLDKKYDENTIDFKHLLSEKNQSLLKDIQNSNSVGVHIRRGDYMTK QNLVIFGNICTQKYYHDAIRIITEKVNDAVFYVFSDDISWQTHLDIPNAVYVWNTGESSIYDMLMSSCKY NIIANSTFSYWAARLNKKTNMVIYPSKWYNTFTPDIFPESWCGI | 189 |
| Candidatus Pelagibacter ubique | WP_020169431.1 | 519013556 | protein [Candidatus Pelagibacter ubique] | 24.32 | | MTIRKLTGGLGNQMFQFATGFAIAKKKNVRSLSDLKYINKRKLFNGFELQKIFNIYSKVSFLNKTLSFKSINFTE ILNRIDTTFYNFKEPHFHYTSNILNLPKHSFLDGVWQSELYFNEFATEIKRIFNFSGKLDKSVLLVADDINRNNSI SIHIRRGDFLLKQNNNHHTDLKEYYLKAINETSKIFKNPKYFIFSDDTSWTVDNFVIDHPYIIVDINFGARSFLD MYLMSLCKSNIIANSSFSWWGAWLNNNKDKIIYAPKNWFNDKSICTDDLIPESWNIIL | 190 |
| Bacteroides sp. CAG:875 | WP_020169431.1 | 519013556 | protein [Bacteroides sp. CAG:875] | 24.29 | | MSVIINMACGLANRMFQYAFYLYLQKEGYDAYVDYFTRADIVHENVDWLRIFPEATFRRATARDIRKMGG GHDCFSRLRRKLLPMTTKVLETSGAPFEIILPPKNRDSYLLGAFQSAKMVESVDAEVRRIFTFPFEFESGKNQYFQ TRLAQENSVGLHIRKGDYQERIWYKNTCGVEYYRKAVDLMKEKVDSPSFVFTDNPAWVKENLSWLEYKL VDGNPGSGWGSHCDMQLMSLCKHNIISNSSYSWWGAYLNNTLNKIVVCPRIWFNPESTKDFSSNPLLAEG WISL | 191 |
| Butyrivibrio fibrisolvens | WP_022756327.1 | 551011911 | protein [Butyrivibrio fibrisolvens] | 24.29 | | MIIIKLQGGLGNQLFLYGLYNLKHLKRDVMDIESGFEGDELRKPCLDCMNLEYAIATRDEVTDIRDSYMDI FSRIRRKITGRKTFDYYEPEDGNYDPKVLEMTKAYLNGYPQSEKYFGDEESVKALKDELITKGKEDILTSTDLITKI YHDIKNSESVSLHIRRGDYLTPGIIRTYGGICTDEYDKAIAMIRETFPEARFFIFSNDIEWCKEKFAGDKNILFV NTIGINLDSEDNIKIGKSDKDISEYRDLAELYLMSACKHHILANSSFSWWGAWLSDHEGMTIAPSKWLNNKN MTDIYTKDMLLI | 192 |
| Roseburia hominis; Roseburia hominis A2-183 | YP_004839455.1 | 347532692 | glycosyl transferase family protein [Roseburia hominis A2-183] | 24.22 | | MVTVKIGDGMGNQMYNYACGYAAAKRSGEKLRLDISECDNSTLRDYELDHFRVVYDEKESPNRTFWQKL YKRLRRDIRYHVIRERDMYAVDARVFVPARRGRYLGHYWQCLGYFEEYLDDLREMFTPAYEQTDAVRELM QQFTQTPTCALHVRGGDLGGPNRAYFQQAIARMQKEKPDVTFIVFTNDPKAKECLDDGEARMYRIAEFGE ALSDIDEFFLMSACQNQIISNSTYSTWAAYLNTLPGRIVIGPKFHGVEQMALPDWIVLDGGACQKGEIDAV | 193 |
| Rhodo-pirellula; Rhodo-pirellula europaea 6C | WP_008659200.1 | 495934621 | alpha-1,2-fucosyl-transferase [Rhodo-pirellula europaea] | 24.16 | | MATSVHPHLSDGKQALDSKAAQQVCSTQAASASDRACTISGGLGNQMLQYAAGRALSIHHDCPLQLDLK FYSSKRHRSYELDAFPIQAQRWIKPSFFSQVLDKIQGESKSAPTYEEQSKRFDRAFFDIELPARIRGYFFSEKYFL PYADQIRTELTPPVPLDQPARDMAQRLSEGMSTLHVRRGDYVSNANARQFWSCTSEYFEAAIEQMPAD STVFVRSDDIEWAKQNIRSSRPTVVNDELKLAGSPETGLRDLWLMTHASKSHIIANSSFSWWGAWLSGSEA NLTIAPKKWFNDPEIDDSDIVPTSWRRI | 194 |

TABLE 1-continued

| Bacterium names | Accession No. | GI No. | Gene name [bacterium] | % identity FutC | Alias | SEQUENCE | SEQ ID NO |
|---|---|---|---|---|---|---|---|
| Rudanelia lutea | WP_019988573.1 | 518832653 | proein [Rudanella lutea] | 24.16 | | MVIAKITSGLGNQLFQYALGRHLAIQNQTRLMFDLRYYHRTYETDTPRQFKLDRFSIDYDLLDYSPWLYVSKA TRLLPGRSLRPLFDTRKEPHFHLDPAVPNAKGAFITLDGFWQSEGYFASNAATIRRELTFTRQPGMYARYR QQIEQTQTPVSVHIRRGDYVSHPEFSQSFGALDDTYYQTALAQINGQPPDATLLVFSDDPEWVRQHMFRER PHVLVENTGPDADVDDLQLMSLCHHHIIANSSFSWWGAWLNPRDKRVIAPKQWFRNKPWNTADLIPAG WVRL | 195 |
| Bacteroidetes; Capnocytophaga sp. oral taxon 329 str. F0087; Paraprevotella clara YIT 11840 | WP_008618094.1 | 495893515 | glycosyltransferase [Bacteroides] | 24.15 | | MRLIKMTGGLGNQMFIYAMYLKMKTIFPDVRIDLSDMVHYQVHYGYEMNKVFHLPRTEFCINRSLKKIIEPL LFKTILERKQGGSLVPYTRKYHWPNIYFKGFYQSEKYFAGIEKEVREAFVFDIRRASRSLRAMQEIKADPHA VSIHVRRGDYLLEKHWKALGCICQSSYYLNALAELEKRVKHPHYVVFSEDLNWVRQNLPLIKAEFIDWNKGE DSWQDMMLMSHCRHHIICNSTFSWWGAWLNGPLDKIVIAPERWTQTTDSADVVPESWLKVSIG | 196 |
| Smaragdicoccus niigatensis | WP_018159152.1 | 516906936 | protein [Smaragdicoccus niigatensis] | 24.08 | | MADVVVTLAGGLGNQLFQTAYAKNLEARGHRVTLDGTVRWTRGLHIDPQICGLKILNATPPAPVPGRLAA TVLRRALATRLRFGPDGRIVTQRTLEFDEQYLNLNSPGRYRVEGYWQCERYFSDVGQTVRKVFLDMLGRH VSYNGLSRLPAMADPSSISLHVRRGDYVTANFIDPLALEYYERALEELAVPSPRIFVFSDDLDWATRELGRICD VIPVEPDWTSHPGGEIFLMSQCSHHIIANSSFSWWGAWLDGRTSSRVVAPRQWFLETYSARDIVPDRWT KV | 197 |
| Bacteroides fragilis CAG:558 | WP_022012576.1 | 547279005 | family 11 glycosyltransferase [Bacteroides fragilis CAG:558] | 24.05 | | MIHLILGGGLGNQMPQYAFARLSALQYNENISFNTILYKELKNEERSFSLGHLNINTMCIVETPDENKRIWELF NKQIFHQKIARKILPASIRWWMSNRNIYANVCGPYKYYHPRHRSQNTTIIHGGFQSWKYFKEHQSMIKAE LKVITPISEPNKKILKEIQNSNSICVHIRRGDFLSAQFSPHLEVCNKDYYEKAIKMISSQIENPTFFIFSNTHEDLV WIRKNYNIPQNSVYVDLNNPDYEELRLMYNCKHFILSNSSFSWWAQYLSESKNKIIIAPKWDKRKGIDFSDIY MPEWIIIK | 198 |
| Desulfovibrio | WP_022657592.1 | 550904402 | protein [Desulfovibrio] | 24.05 | | MSFSIDVAAIQRMALVKVDGGLGSQMWQYALSLAVGKKSSSFTVKHDLSWFRHYAKDIRGIENRFFILNSVFT NINLRLASENERLFFHIALNRYPDSICNFPDDILALKQPTYLGGYYVNAQVTSAEKEIREAYVFAPAVEESNQA MLQTIHAAPMPVAVHVRRGDYIGSMHELVTPRYFBRAFKILAAALQPKPTFVSNGMEWTKKAFAGLPYD FVYVDANDNDNVAGDLFLMTQCKHFTISNSLSWWGAWLSQRAENKTVIMPSKWRGGKSPIPGECMRV EHWHMCPVE | 199 |
| Hoeflea photo-trophica; Hoeflea photo-trophica DFL-43 | WP_007199917.1 | 494373839 | alpha-1,2-fucosyltransferase [Hoeflea photo-trophica] | 24.05 | | MHGGLGNQLFQYAVGRAVALRTGSELLLDTREFTSSNPFQYDLGHFSIQAKVANSSELPPGKNRPLAYAW WRKFGRSPRFVREQDLGYNARIETIEADCYLHGYFQSQKYFEDIASILWKDLSFRQAISGENASMAERIQSAP SVSMHIRRGDYLTSAKARSTHGAPDLGYGRALGEIRARSGSDPVVYLFSDDPDWVRNNMRMDANLVTVA INDGKTAFEDLRLMSLCDHNIIVNSTFSWWGAWLNPSLDKIVVAPKRWFADPKLSNPDITPPGWLRLGD | 200 |

TABLE 1-continued

| Bacterium names | Accession No. | GI No. | Gene name [bacterium] | % identity FutC | Alias | SEQUENCE | SEQ ID NO |
|---|---|---|---|---|---|---|---|
| Vibrio cholerae; Vibrio cholerae O1 str. 87395 | WP_002030616.1 | 487957217 | glycosyl transferase family 11 [Vibrio cholerae] | 24.04 | | MKIIFSFSGGLGNQLFQYAFYLKDNSDFGNIFLDFSFYESQNKRDAVIRNFYGVDSLDIIKQSSYVRGKFLILKL INKFRFFNNLLEFVDKENGLDETLLSTNKVFFDGVWQSYRYVKDYKSNIKELFSFYDFKGNILEVRKKICQSNSV CMHVRRGDYVAEKNTKLVHGVCSLQYRDALNNIKNVDNSIDHIFIFSDDIDWVKNNISFDIPVTVVDFVGQ SVPDYAEMLLFSCGKHKVIANSTFSWWGAFLSDRNGVIVSPKKWFAKEEKNYDEIFIEGSLRL | 201 |
| Lachno-spiraceae bacterium NK4A179 | WP_022784718.1 | 551041074 | protein [Lachno-spiraceae bacterium NK4A179] | 24.03 | | MIIVRFRGGMGNQMFQYAFLRYLEMKGATLKADLSEFKCMKTHAGYELDKAFDLHPAEASYKEIRAVADYI PVMHRFPFSRKVFEILYKKEKRVEAEGPKKSHISEEKYFDMSEDERLHLASSSEDLYMDGFWIKPDMYDDE VLKCFTFSKTLDEKYKGTIEDIHSCSVHVRCGDYTGTGLDILGKEYEKAAEKILSEDADVKFYVFSDDREKAEK LLSPFMKKMVFCDTPASHAYDDMYLMSRCRHHIANSTFSFWGAARLSADKSGITICPKYEDKNNTANRLVHE GWQML | 202 |
| Cecembia lonarensis; Cecembia lonarensis LW9 | WP_009185692.1 | 496476931 | Glycosyl-transferase family 11 [Cecembia lonarensis] | 24.01 | | MIIMKPMGGLGNQIIQYALGRKLSELHNSFLASHIHIYKNDPDREFVLDKRNIKNKHLPWKVIKLLNSDYALKF DKVFHTEFYHELVLEKALESKDIPRKNNLYLRGSWGNRKYYEDYIKDISDEITLLEKFKTKDFNTVNKKVKNSDS VGIHIRRGDYEKVAHFKNFYGLLPPSYYSAAVDFIGNRIEKSNFFISDDTDWVKENLPFLKDSFVSDIIGSVD YLEFELLKNCKHQIIANSTFSWWAARLNSNPAKIVIPKRWFADDRQQAVYEIEDSYYIKEAIKL | 203 |
| Bacteroides ovatus; Bacteroides ovatus ATCC 8483 | WP_004295547.1 | 490423336 | protein [Bacteroides ovatus] | 24 | | MKIVNILGGLGNQMFVYAMYLALKEAHPEEEILLCRRSYKGYPLHNGYELERIFGVEAPEAALSQLARVAYPF FNYKSWQLMRHFLPLRKSMASGTTQIPFDYSEVTRNDNVYDGYWQNEKNFLSIRDKVIKAFTPBFRDEK NKALSDKLKSVKTASCHIRRGDYLKDPIYGVCNSDYTRAITELNQSVNPDMYCIFSDDIGWCKENFKFLIGDK EVVFVDWNKGQESFYDMQLMSLICHYNIIANSSFSWWGAWLNNNDDKVVVAPERWMNKTLENDPICDN WKRIKVE | 204 |
| Bacteroides coprocola CAG:162 | WP_022125287.1 | 547668508 | glycosyl transferase family 11 [Bacteroides coprocola CAG:162] | 23.99 | | MRLIKMTGGLGNQMFIYAFYLMKKLFPHTKIDLSDMMHYHVHHGYEMNRVFALPHTEFCIBNRTLKKLME FLLCKVVYERKQKNGSMEAFEKKYAWPLIYFKGFYQSERFFADIEDDVRKTFCFNMELINSRSREMMKIDAD EHAVSIHIRRGDYLLPKFWANAGCVCQLPYYKNAITELEKEHESTPSFYVFSDDIEWVKQNLSLPNAHYIDMN QGNDSWQDMMLMSHCRNHIICNSTFSWWGAWLNPRNKTVIVPSRWFMKEETPIYPVSWIKVPIN | 205 |
| Bacteroides dorei; Bacteroides dorei DSM 17855; Bacteroides dorei CL02T12C01 | WP_007835585.1 | 495110765 | gylcosyl-transferase [Bacteroides dorei] | 23.99 | | MRLIKVTGGLGNQMFIYAFYLRMKKYYPKVRIDLSDMMHYKVHYGYEMHRVFKLPHTEFCINQPLKKIIEPLF FKKIYERKQAPNSLRAFEKKYFWPLLYFKGFYQSERFFADIKDEVREAFTPDRSKANSRSLDMLDILDKDENAV SLHIRRGDYLQPKHWATTGSVCQLPYYQNAIAEMSKRVTSPSYYIFSDDIVWRENLPLQNAVYIDWNTGE DSWQDMMLMSHCKHHIICNSTFSWWGAWLNPSIDKTVIVFSRWFQYSETPDIYPTGWIKPVD | 206 |
| Bacteroides; Bacteroides intestinalis DSM 17393; Bacteroides intestinalis CAG:564 | WP_007662951.1 | 494936920 | protein [Bacteroides] | 23.97 | | MIIVRLWGGLGNQLFQYSFGQYLEIETDKKVFYDVASFTSDQLRKLELCSFIPDIPLYNAYFTRYTGVKNRLF KALFQWSNTYLSESMFDICLLEKARGKIFLQGYWQDEKYATYFPMQKVLSEWKNPNVLSEIEENIRSAKISVS LHVRRGDYFSPKNINVYGVCTEKYYBQAIDRANSEIEEDGQFFVFSDDIIWVKNHVSLPESTVFVPNHEISQFA YIYLMSLCKVNIISNSTFSWWGAYLNQHKNQLVIAPSRWTFTSNKTLALDSWTKI | 207 |

TABLE 1-continued

| Bacterium names | Accession No. | GI No. | Gene name [bacterium] | % identity FutC | Alias | SEQUENCE | SEQ ID NO |
|---|---|---|---|---|---|---|---|
| Lachnospiraceae bacterium A4 | WP_016283022.1 | 511028838 | protein [Lachnospiraceae bacterium A4] | 23.95 | | MIVIHVMGGLGNQLYQYALYEKLRALGREVKLDVYAYRQABGAEREMRALELEWLEGIRYEVCTAAERQQL LDNSMLADRVRRRLTGRRDKTVRECAAYMPEIFEMDDVVLYGFFWGCEKYYEDIIPLLQEKIVFPESSNPKN ADVLRAMAGENAVSVHIRRKDYLTVADGKRYMGICTDAYYKGARFYITERVERPVYIFSDDPAFAKTQFCE ENMHVVDWNTGRESLQDMALMSRCRHNICANSTFSIWGARLNRHPDKIMIRPLHHDNYEALDARTVHEY WKGWVLIDADGKV | 208 |
| Phaeobacter gallaeciensis; Phaeobacter gallaeciensis DSM 17395 = CIP 105210 | YP_006574665.1 | 399994425 | protein PGA1_c33070 [Phaeobacter gallaeciensis DSM 17395 = CIP 105210] | 23.91 | | MIITRLHGRLGNQMFQYAAGRALADRLGVSVALDSRGAELRGEGVLTRVFDLDLATPDILPPLRQRAPLGYA LWRGLGQHLGTGPKLRREVGLGYNPDFVDWSDNSYLHGYWQSERYFAWSAERIRRDFTPEYSNQQNAE MAARIGETNAISLHVRRDGYLTLAAHVKCDQAYYRAALAQVLDGLEGQPTVYVFSDDPQWAKENLPLCDK VVVDFNGADTDYEDMRLMSLCKHNIIGNSSFSWWAAWLNGTPDRRVAGPTKWFGDPKLNNPDILPPDW LRISV | 209 |
| Firmicutes bacterium CAG:791 | WP_021849028.1 | 546362318 | protein [Firmicutes bacterium CAG:791] | 23.88 | | MSGGLGNQMFQYALYLKLRSLGREVCFDDKSQYDEETFRNSSQKRRPKHLDIFGITYPSAGKEELEKLTDGA MDLPSRIRRKILGRKSLEKNDRDFMPDPSFLEETEGYFCGGFQSPRYFAGAEEEVRKAFTPPEELLCPKEGCSR EQEKMLEQSASYAERIRKANCEAADRGVPGGGSASIHLRFGDYVDKGDIYGGICTDAYYDTAIRCLKERDPG MIFFVFSNDEEKAGEWIRYQAERSENLIGRGHFVLVKGCDEDHGYLDLYLMTLCRNHVIANSSFSWWASFM CDAPDKMVFAPSIWNNQKDGSELARTDIYADFMQRISPRGTRLSDRPLISVIVTAVNVAPYIGRALDSVCGQ TWKNLEIIAVDDGSSDETGAILDRYAAGDSRIQVVHTENRGVSAARNEGIAHARGEYIGFVDGDDRAHPAM YEAMRIGILSSGADMAVVRTREVSAEETLTDAEEQVASFDEVLRASVLLQQRDAVQCFIRAGMAEEEGKIVL RSAVWNKLFHRRLLRDNRFPEGTSAEDIPFTTRALCLSKKVLCVPEILYDVVVNRQESIMNTGRAERTLTQEIP AWRTHLELLKESGLSDLAEESEYWFLYRRMSLYEEEYRRCSETAKEAKELQERILKHRDRILELAEEHSFGRRGD RERLKLYVNSPRQYFLLSDLYEKTVVNWKNRPDKT | 210 |
| Butyrivibrio proteoclasticus; Butyrivibrio proteoclasticus B316 | WP_003829733.1 | 302669773 | glycosyltransferase 11 [Butyrivibrio proteoclasticus B316] | 23.84 | | MRKRIIALNGLGNQMPQYAFARMLEDRKHCLIEPDTGFYSTVNDRKLAIQNYNIHKYDFCNHEYNKIRLLF QKIPFVAWLAGTYRGYSEYQLDPRVFLFNYRFYYGWQNKQYFENISNDIRNELSYIGNVSEKENALLNMLEA HNAIAIHVRGDYTQEGYNIKYIYISLSEKEYYKRAVSIACKELGDNNIPLYVFSDDIDWCKANLADIGNVTFVDNT ISSSADIDMLMMKKSRCLITANSTFSWWSAWLSDRDDKIVLVPDKWLQDEEKNTKLMKAFICDKWKIVPV | 211 |
| Bacteroides sp. 2_1_16 | WP_008768245.1 | 496043738 | protein [Bacteroides sp. 2_1_16] | 23.81 | | >gi|496043738|ref|WP_008768245.1|protein[Bacteroides sp. 2_1_16]MQVVARIIGGLGNQMFIYATARALALRIDADLILDTQSGYKNDLFKRNFLLDSFCISYRKANCFQKY DYYLGEKVKSLGKKTHFSVIPFMKVISENTSCDFVDGLLKVHILSVYLDGYWQNEAYFRDYASIIKKDFQFCQV NDLRTLSEAEIIKKSITPVAIGNRRYQELNSHQNTKVTDLDFYQKAINYIBSKVDMPTFFIFSEDQEWKNNLEQ KSNFIMISPKEGNYSALNDMVLISLCKHHIVSNSSFYWWGAWLANNKNKIVVASDCFLNPQSIPDSWIKF | 212 |
| Desulfomicrobium baculatum; Desulfomicrobium baculatum DSM 4028 | YP_003159045.1 | 256830317 | glycosyltransferase family protein [Desulfomicrobium baculatum DSM 4028] | 23.76 | | >gi|256830317|ref|YP_003159045.1|glycosyl transferase family protein [Desulfomicrobium baculatum DSM]MAKIVTRIMGGIGNQLFCYAAARLALVNHAELVIDDVTGFSRDRVYRRRVMLDHFNISARKATNYE RMEPFBRYRRGLAKYISKKLPFFEREYIEQERIEFDPRFLEYRTYNNIYIDGLMQSENYFKDVEDIIRDDLKIPPT DLENINIAKKLKNIQNTIAMHVRWFDLPGINLGNNVSTYYYHRAIAMMEQRINAPHYFLFSDNLEAVHSKLD LPEGRVTFVSNNDGDDNAYADLWLMSQCKHFITANSTFSWGAWLGESRDSVVLVPRFSPDGGVTSWC FTGLIPERWEQVSSIR | 213 |
| Prevotella pleuritidis; | WP_021542436.1 | 545304945 | galactoside 2-alpha-L- | 23.76 | | MDIVLIFNGLGNQMQSAFYLAKRQRNNHTVYCHFGPRTQYSLDKLFDIPYRHNAVLIVLLYRALDHAHFSN HRWLRLLRPTLQLLGVKMIVERPSRDFDMHFTHQKGIVFYRGGWHSELNFTAVADAVKRFRFPEIQDA | 214 |

TABLE 1-continued

| Bacterium names | Accession No. | GI No. | Gene name [bacterium] | % identity FutC | Alias | SEQUENCE | SEQ ID NO |
|---|---|---|---|---|---|---|---|
| Prevotella pleuritidis F0068 | | | fucosyltransferase [Prevotella pleuritidis] | | | AVLAVIDRIKSCQSVSLHLRRGDYLSLSEQFVCTEAYYEHAIAYFESQIESPEYFVFSDDPTYAREQFGADPNF HIIDLNHGEDAWCDLLMMTQCRYNIIASNTFSWWGAWLNDNPSKIVHPRYHLNGVETRDFYPRNWICIE | 215 |
| Bacteroides sp. 1_1_14 | WP_008763191.1 | 496038684 | glycosyltransferase, family 11 [Bacteroides sp. 1_1_14] | 23.75 | | MKVIWFNGNLGNQVFYCKYKEFLHNKYPNETIKYYSNSRSPKICVEQYFRLSPDRIDSFKVRFVEFLGKFFR RIPLKVPKWYCTRKSLNYEASYFEHYLQDKSFFEKEDSSWLKAKKPDNFSEKYLIPENLICNTNSVANHIRRGD YIKPGSDYEDLSATDYYEQAIKKATEVYLDSQFFFFSDDLEFVKNNFKGDNIYYVDCNRGADYLDILLMSQAK INIIANSTFSYWGAYMNHEKKKVMYSDLWFRNESGRQPNIMLDSWICIETKRK | 216 |
| Agromyces subbeticus | WP_022893737.1 | 551273588 | protein [Agromyces subbeticus] | 23.65 | | MVGRVGIARRQAADVSCTDGDGLVAWRIRTGEIVLGLQGGIGNQLPEWAFAMALRSIGRRVLFDAVRCRG DRPLMIGPLLPASDWLAAPVGLALAGATKAGLLSDRSWPRLVRQRRSGYDPSVLERLGGTSYLLGTFQSARY FDGVEHEVRAAVRALLEGMLTPSGRRFADELRADPHRVAVHVRRGDYVSDDPNAAVRHGVLGAGYTDQAL EHAAALGHVRRVWFSDDLDWVREHLARDDLLCPADATRHDGGEIALIASCATRIIANSSFSWWGGWLG APSSPAHPVIAPSTWFADGHSDAAELVPRDWVRL | 217 |
| Prevotella salivae; Prevotella salivae DSM 15606 | WP_007133870.1 | 494220705 | alpha-1,2-fucosyltransferase [Prevotella salivae] | 23.59 | | MIATTLFGGLGNQMFIYATAKALSLHYRTPMAFNLRQGFEQDYKYQRHLELNHFKCQLPTAKWITFNYKGE LNIKRISRRIGRNLLCPHYQFIKEKEPFHYEKRLFEFTNKKIFLEGYWQSPRYFENYSDEIRRDFQLKSILPHTITD ELQMLKGTGKPLVMLGIRRYQEVKDKKDSPYPLCNKDYYAKAISHVQEQLPAPLFVVFTQEQAWAMNNLP TNANLYFVKEKDNAWATIADMYLMTQCQHAIISNSTFYWWGAWLQHPIENHIVVAPNNFINRDCVCDN WIILD | 218 |
| Carnobacterium sp. WN1359 | YP_008718687.1 | 554649641 | glycosyltransferase [Carnobacterium sp. WN1359] | 23.57 | | MIFVDLSEGLGNQMFQYAYSRYLQELYGGTLYNTSSFKRKNSTRSYSLNNFYLYENVKLPSKFRRVIYNFYSK TIRMFIKKVIRMNPYSDKYYPSMIPYGFYVSSQVFKYLTVPTTKRHNIFMGTWQTNKYFQSINDKIKDELKV KTEPNELNKKLITEINSNQSVCVHIRLGDYTNPEPDYLVCTSDYYLKGMDYIVSKVKEPNFYIFSNSSSDIEWI KNNFYFKYKVKYIDLNNPDFEDFRLMYNCHHFIISNSTFSWWAQFLSNNDKKIIVAPSKWQKSNENEAKDIY LDHWKLIEIE | 219 |
| Butyrivibrio sp. AD3002 | WP_022762290.1 | 551018062 | glycosyltransferase [Butyrivibrio sp. AD3002] | 23.55 | | MLIIQIGGLGNQMQQYALYEKFKALGKETRLDTSWFDNASMQENVLARRSLELRFFDNLTYEACTPQERA RFTDSVARVVEKLVPGMGSRFTESCMYHPEIFELKDKYIEGYFACQKYYDDIMGELQELFVFPTHPDEEINI KNMNLMEMEMVPSVSVHIRGNTGKYSLLDIQLMSHCRGNICANSTFSFWGARLNRRKDKIPVRTLVMRNNQPVTPELMH EYWPGWVLVDKDGKVR | 220 |
| Clostridium sp. KLE 1755 | WP_021636935.1 | 454396682 | glycosyltransferase, family 11 [Clostridium sp. KLE 1755] | 23.55 | | MIVIRVMGGLGNQMQQYALYEKFKALGKETRLDTSWFDNASMQENVLARRSLELRFFDNLTYEACTPQER EALLGKEGFFNKLERKLFPSKNKHFYESEMPHPEIPKLDNVYLEGHWACEKYYHDIMPLLQSKIIPPKTDNIQN NMLKNKMNSENSVSIHIRRGDYLDPENAAMFGGICTDSYYKSAEGYIRNRVTNPHFYLFSDDPAYLREHYKG EEYTVVDWNHGADSFYDMELEMSCCKHNVCANSTFSFWGARLRTEKKIVIRPAKHKNSQQAEPERMHEL WENWVIIDEEGRIV | |
| Bacteroides; Bacteroides vulgatus ATCC 8482; Bacteroides dorei DSM 17855; Bacteroides | YP_001300694.1 | 150005950 | glycosyltransferase family protein [Bacteroides vulgatus ATCC 8482] | 23.47 | | MKFFVPGGGLGNQLFQYSYRYLKKYPSERILGIYPDSLKAHNGIEIDKWFDIELPPTSYLYNKLGILLYRVNRF LYNGHYRLLFCNRVYPQSMKHFFQWGDWQDYSIIKQINIFEFRSELLPIGKENMEFLKKMETCNSISVHIRRG DYLKTDLIHIYGGICTSKYYREAIKPMEQEVEEPFFFFSDDCLVETEFADIRNKIIISHNRDDRSFFDMYLMAH AKNMILANSTFSCCWAAYLNRTAKIIITPDRWVNTDFSKLEALPNEWNIKIRV | 221 |

TABLE 1-continued

| Bacterium names | Accession No. | GI No. | Gene name [bacterium] | % i-dentity FutC | Alias | SEQUENCE | SEQ ID NO |
|---|---|---|---|---|---|---|---|
| Paraprevotella xylaniphila; Paraprevotella xylaniphila YIT 11841 | WP_008626629.1 | 495902050 | glycosyl-transferase [Paraprevotella xylaniphila] | 23.47 | | MRLIKMTGGLGNQMFIYAMYLKMRAVFPDTRIDLSDMVHYRVHYGYEMNKVFNLPRTEFRINRSLKKIIEFL LFKTIILERKQGGSLVFYIRKYHWPWIYFKGFYQSEEYFAGVEKEVREAFVFDVRRVNRKSLCAMQEIMADPD AVSIHVRRGDYLQGKHWKSLGCICQRSYYLNALSELEKRIVHPHYVFSEDLDWVRQYLPLENAVFIDWNKG EDSWQDMMLMSHCRHHIICNSTFSWGAWLNPSPDKIVIAPERWTQQTTNSADVVPESWLKVSIG | 222 |
| Thauera sp. 28 | WP_002930798.1 | 489020296 | glycosyl-tansferase family protein [Thauera sp. 28] | 23.47 | | MTDRALIAIVKGGLGNQLFIYAAARAMALRTGRQLYLDAVRGYLADDYGRSFRLNRFPIEAELMPEQWRVA STLRHPRAKLVRALNKYLPRAWRFVVAEFGTRPGALWNHGRNVKRVTLMGYWQDRAYFLDYAELLRREL GPPMPDAPEVRARGEFFAGTESVFLHVRRCRYSPLLDAGYYQKAVDLACAELNKPVFMIFGDDIEWVVNNI DFRGAGYERQDYDESDELADLWLMTRCRHAIIANSSFSWWAAWLGGAAGSGRHVWAPGQSGLALKCAK SWEAVDAQPE | 223 |
| Subdo-ligranulum variabile; Subdo-ligranulum variabile DSM 15176 | WP_007048308.1 | 494107522 | alpha-1,2-fucosyl-transferase [Subdoligranulum variabile] | 23.44 | | MIYAELAGGLGNQMFIYAFARALGLRCGEAVTLLDRQDWRDGAPAHTACALEGLNLVPEVKILAEPGFAKR HLPRQNTAKALMIKYEQRQGLMARDWHDWERRCAPVLNLLGLHFATDGYTPVRRGPARDFLAWGYFQS EAYFADFAPTIRAELRAKQAPAGVWAEKIRAAACPVALHLRRGDYCRPENEILQVCSPAYYARAAAAAAY PEATLFVFSDDIDWAKEHLDTAGLPAVWMPRGDAVGDLNLMALCRGFILSNSTYSWWAQYLAGERTV WAPDRWFAHTKQTALYQPGWHLIETR | 224 |
| Firicutes bacterium CAG:24 | WP_021916223.1 | 547127527 | protein [Firmicutes bacterium CAG:24] | 23.4 | | MIIVEVMGGLGNQMQQYALYRKLESLGKDARLDVSWFLDKERQTKVLASRKLELSWFENLPAKYCTQEEK QAILGKNNLIGKLKKLLGGSNRHFTESDMTHPEIFDLEDAYLSGFWACEAYYADILPLMLRSQIHPDPEKGE GWDLEAAAKNKETMERMKQETSVSIHIRRGDYLDAKNAEMPGGICTDAYYEAAISYIKEQTPDAHFYVFSD DSAYVKNAYPGKEFTVVDWNTGKNSLFDMQLMSCCNHNICANSTFSWGARLNPSDKVMIRPSKHQNS QNIVPEEMKRLWDGWVLIDGKGRII | 225 |
| Prevotella sp. CAG:474 | WP_022310139.1 | 547906803 | glycosyl-transferase family 11 [Prevotella sp. CAG:474] | 23.39 | | MIITKLNGGLGNQLFEYACARNLQLKYNDVLYLDIEGFKRSPRHYSLEKFKLSSDVRMLPEKDSKSLILLQAISK LNRNLAFKLGPLFGTYIWKSSNYRPLKIKNTRGKKLYLYGYWQSYEYFKENEAIIKQELNVKETIPIECSELLKEIN KPHSICVHVRRGDYSVSCGFLHCDEAYYNRGINHIFDKHPDSNVVFSDDIKWVKANMNFDHPVAYVEVDV PDYETLRLMYMCKHFVMSNSSFSWWASYLSDNKEKIVVAPSYWLPANKDNKSMYLDNWTIL | 226 |
| Roseburia intestinalis; Roseburia intestinalis L1-82 | WP_006855899.1 | 493910390 | gylcosyl-transferase family 11 [Roseburia intestinalis] | 23.38 | | MRGNRGMIAVKIGDGMGNQLFNYACYAQARRDGDSIVLDISECDNSTLRDFELDKFHLKY DKKESPNRNLGQKIYKNLRRALKVHVIKEREVYHNRDHRYDVNDIDPRVYKKKGLRNKYLYGYWQHLAYFE DYLDEITAMMTPAYEQSETVKKLQEEFKKTPTCAVHVRGGDIMGPAGAYFKHAMERMEQEKPGVRYIVFT NDMERAEEEALAPVLRSQKKDAVGQAENRLBFVSEMGEFSDVDEFFLMAACQNQILSNSTFSTWAAYLNQN PDKTVIMPDDLLSERMRQKNMILK | 227 |
| Bacteroides ovatus; Bacteroides ovatus ATCC 8483 | WP_004296622.1 | 490424433 | protein [Bacteroides ovatus] | 23.29 | | MKIVLFTPGLGNQMFQYLFLYRDNYPNQNIYGYYNRNILNKHNGLEVDKVFDIQLPPHTVISDASAFFIRA LGGLGKYFIGKDQLSPWKVYFDGYWQNKEYFQNNVDKMRFREEGFLNKKNDDILSLIRNTNSVSNHVRRG DYCDSCRKDLFLQACTPQYYEBSAISVMKEKFQKPVFFVFSDDIPWKVNLNIPNAYYIDWNKKENSYLDMYL MSLCTASIIANSTFSPWGAMLGNKKELVIKPKKWIGDEIPEIFPPSWLSL | 228 |

TABLE 1-continued

| Bacterium names | Accession No. | GI No. | Gene name [bacterium] | % identity FutC | Alias | SEQUENCE | SEQ ID NO |
|---|---|---|---|---|---|---|---|
| Butyrivibrio sp. AE3009 | WP_022779599.1 | 551035785 | gylcosyl-transferase [Butyrivibrio sp. AE3009] | 23.25 | | MLIIQAGGLGNQMQYALYRKLLKYHPDGVRLDLSWFDSEVQKMLAKREFELALFKGLPYIECKPEERRA FLDRNAAQKLSGKVLKKLGLRDNANPNVFEESRMFHPEIFELDNKYIIGYPACQKYDDIMGDLCNLFEFPEH LDPELEKKNLELISKMEKENSVVHIRRGDYLDPENFKILGNIATDEYYESAMKYFEDRYEKVHFYIFTSDHEYA REHFADESKYTIVDMNTGKDSLQDVRLMNHCKGNICANSTFSWGARLNQRQDKVMIRTYKMRNNQPV DPDTMHDYWKGWILIDETGREV | 229 |
| Butyrivibrio proteoclasticus; Butyrivibrio proteoclasticus B316 | WP_003829712.1 | 302669752 | glycosyl-transferase 11 [Butyrivibrio proteoclasticus B316] | 23.23 | | MTKNEKKLIVKPQGGLGNQLYEYAFCEWLRQQYSDYEVLADLSYYKIRSAHGELGIWNIFPNINIEVASNWDI IKYSDQIPIMYGGKGADRLNSVRTNVDRFFSKRKHSYYTEISNTDVSEVINALNNGIRYFDGYWQNIDYFKG NIEDLRNKLKFSEKCDKYITDEMLRDNAVSLHVRRGDYVGSEYEKEVGLSYYKKAVEYVLDRVDQAKFFIFSD DKYYAETAFEWIDNKTVVAGYDNELAHVDMLLMSRMKNNIIANSTFSLWAAYLNDSMNPLIVYPDVESLD KKTFSDWNGIIK | 230 |
| Prevotella nanceiensis | WP_018362656.1 | 517173838 | protein [Prevotella nanceiensis] | 23.23 | | MKSQFLKHIKLSGGFGNQLFQYFFGEYLKEKYNCSISFFSEPALDINQLQIHRFFPALRISHNTELRPYHYSFTQ QLAYRCMRKLLLFPPLNRVKIENGSNYQNQSFNDTYCFFDGYWQSYRYLSAFTPSLQFEDQLINDISADYIN AIEQSEAVFLHIRRGDYLNKENQKVFACECPLNYFENAANRIKEDIKNVHFFVFSNDIQWVKSHLKLNDNEVTF IQNEGNSCDLKDFYLMTRCKHAIISNSTFSWAAYLINNSDKKVIAPKHWYNDISMNNAATKDLIPPTWIRL | 231 |
| Ruegeria sp. R11 | WP_008562971.1 | 495838392 | aplha-1,2-fucosyl-transferase [Ruegeria sp. R11] | 23.23 | | MIITRLHGRLGNQMFQYAAGRALADRAGVPLLALDSRGAILRGEGVLTRVFDLELADPVHLPPLKQTNPLRYA IWRGIGQKVGAKPYFRRERGLGYNPAFEDWGDSNYLHGYWQSQKFYQNSAERIRSDFTFPAFSNQQNAE MAARIAESTAISLVHVRRGDYLTFAAHVLCDQAYYDAALAKVLCQGDPIVYVFSDDPQWAKDNLSLPCEK VVVDFNGPETFDFEDMRLMSLCQHNITGNSSFSWWAAMLNQTPGRRVAGPAKWFGDPKLSNPDIFPHDW LRISV | 232 |
| Winogradskyella psychrotolerans RS-3; Winogradskyella psychrotolerans | WP_020895733.1 | 527072096 | aplha-1,2-fucosyl-transferase [Winogradskyella psychrotolerans] | 23.21 | | MGNQLYEYATAKAMAVALNKKLVIDPRPILKEAPQRHYDLGLFNIQDEDFGSPFVQMLVRWVASVRLGKFF KTIMPFAWSYQMIRDKEEGFDESLLQQKSRNIVIEGYWQSPKYFESIRPTLLKELSFKDKPNAINQKYLDEISV NAVANHIRRGDYVANPVANAVHGLCDMDYYKKAIAIIKDKVENPYFFIFTDDPDWAEKNFKISEHQKIIKHNI GKQDHEDFRLLTNCKYFIIANSSFSWWGAWLSDYKNKIVISPNKWFNVDAVPITERIPESWIRV | 233 |
| Lachnospiraceae bacterium NK4A179 | WP_022785341.1 | 551041720 | protein [Lachnospiraceae bacterium NK4A179] | 23.2 | | MITVRIDGGFGNQMFQYAFFLHLKTITDNKISVDLNCYNPHGSGDIFTRPKLAPEQAAPSEIKRPHRNSIYHL LRPLDSAGITTNPYYREEDIDDLNSVLNKKRVYLRGYWQDKRYPPFSVKDQLIDCFDLGKMDTGASAENNVI LEQIASEESRSVGBHLRGGDYIGDPVYSGICTPEYYEAAFKHVSEKIKDKVFHIFTNDISMIEKCGLSGKYDLKIT DINDEAHGWADLKLMSACRHHIISNSSFSWWAAFLGEATTEASADVINVIPEYMRQGVSAETLRCPCWTT VTSDGRVYPS | 234 |
| Prevotella sp. oral taxon 317 str. F0108; Prevotella sp. oral taxon 317 | WP_009230832.1 | 496522549 | aplha-1,2-fucosyl-transferase [Prevotella sp. oral taxon 317] | 23.13 | | MKIVCIKGGLGNQLFEYCRYRSLHRHDNRGVYLHYDRRRTKQHGGWLDKAFHITLPNEPLRVKLLVMVLK TLRRLHLFKRLYREEDPRAVLIDDYSQHKQYITNAAEILNRPFEQLDYABEIQTTPFAVSVHVRRGDYLLLANK SNFGVCSVHYLSAAVARERHPESRFFVFSDDMEWAKENLNLPNCVFVEHAQAQPDHADLYLMSLCKGH IIANSTFSFWGAYLSKGSSAIAIYPKWFAEFTWNVPDIFPAHWMAL | 235 |

TABLE 1-continued

| Bacterium names | Accession No. | GI No. | Gene name [bacterium] | % identity FutC | Alias | SEQUENCE | SEQ ID NO |
|---|---|---|---|---|---|---|---|
| Butyrivibrio sp. XPD2006 | WP_022765796.1 | 551021633 | glycosyl-transferase [Butyrivibrio sp. XPD2006] | 23.1 | | MLIIQIAGGLGNQMQQYAVYTKLRGMGKDVRLDLSMFDPSVQKNMLAPREFELSMPEGVDYTECTAEER DSFLKQGMIANVTGKMLKKLGLRDEANPKVFSEKEMYHPEIFELEDRYIKGYFACQKYDDIMGELMEKTF PAHSDPDLHTRNMALVERMEKETSVSVHIRRGDYLDPSNVEILGNIATEEYYQGAMDYFSVKDPDTHFYIFT SDHEYAREKFSDESKYTIVDMNSGRNSVQDLMLMSHCKGNICANSTSFWGARLNRRPDKTVIRTYKMRN NQPVNPDIMHDYWKGWILMDEGSII | 236 |
| Butyrivibrio fibrisolvens | WP_022752717.1 | 551008140 | protein [Butyrivibrio fibrisolvens] | 23.08 | | MIIIKQGGLGNQLFLYGLYNLKHLKRDVKMDIESGFEEDKLRVPCLKSMGLDYEVATRDEIVAIRDSYMDIF SRIRRKITGRKTFDYYEPEDGNFPDPRVLEQTHAYLDGYFQSEKYFGDSDDRKKLKDELLKEKIRVLDSSDTLKDL YNMMSSGSSVSLHIRRGDYLTPGIMETYGGICTDEYYDIAMNRIKNEYPDSKFFIFSNDIDWCKEKYGSRDDV IFVDSCDEHEGLTNVSGDQDDIQVQGDIKEHGNNSLRDAAELYLMSACKHHILANSSFSWWGAWLSDHEG MTIAPSKWLNNKNMTDIYTKDMLLI | 237 |
| Cylindrospermopsis raciborskii; Cylindrospermopsis raciborskii CS-505 | WP_006278973.1 | 493321658 | Glycosyl-transferase family 11 [Cylindrospermopsis raciborskii] | 23.05 | | MKKTVVLLKGGLGNQMFQYAFARSISLKNSSKLVIDNWSGFTFDYKHRQYELGTFSIVGRPANLTEKPFW FYELKSKFFPRLPKVFQQQFYGLLINEVGGEYIPEIEETKISQNCWLNGYWQSPLYFQKHSDSITRELMPPEPM EKHFLELGKLLRETESVALGIRLYEESKNPGSHSSSGELKSHFEINQAILKLRELCNGAKFFVFCTHRSPLLQELAL PENTIPVTHDDGYVGSMERMWLLTQCKKHHIFTNSTPYWWGAWLSQKFYIQGSQIVFAADNFINSDAIPKH WKPF | 238 |
| Prevotella multiformis; Prevotella multiformis DSM 16608 | WP_007368154.1 | 494609908 | alpha-1,2-fucosyl-transferase [Prevotella multiformis] | 23.05 | | MKIVNFQGGLGNQMFIYAFSRYLSRLYPQEKIYGSYWSRSLYVHSAFQLDRIFSLQLPPHNLFTDCISKLARFF ERLRLVPVEETPGSMPYNGYWLDKKYWEGIDLSEMFCFRNPDLSAEAGAVLSMIERSNAVNHIRRGDYQS EEHIEKFGRFCPPDYRIATERIRQREDDPLFFVFSDDMMVKSNMDVPNAVYVDCHHGDDSWKDMFL MAKCRNHIIANSTFSFWAAMLNANPDKVVVYPQRWFCWPSPDIFPEMWLPVTEKEIKSSF | 239 |
| Bacteroides sp. CAG:462 | WP_022384635.1 | 548151455 | protein [Bacteroides sp. CAG:462] | 23 | | MIIVNMACGLANRMFQYAFYLSLKERGYNVKVDFYKSATLPHENVPWNDIFPYAEIDQVSNFRVLILGGGA NLLSKLRRKYLPSLTNVITMSTAFDTDLQIDDDRKDKYIIGVFQSAAMVEGVCKKVKQCFSFLPFTDLRHLQLE KEMQECESVAIHVRKGNDYQQRIWYQNTCTMDYYRKAIAEIKGKVKDPRFYVFTDNADWVRRNFTDFDYK MVEGNPVYGWGSHFDMQLMSRCKYNIISNSTYSWWGAYLNANRKIVICPNIWFNPESCNEYTSCKLLCK GWIAL | 240 |
| Desulfovibrio africanus; Desulfovibrio africanus PCS | WP_005984176.1 | 492830222 | Glycosyl-transferase family 11 / Glycosyl-transferase family 6 [Desulfovibrio africanus] | 23 | | MRIGILYICTGKYTVFWNHFPTSCEQHFLREHEKHYYIFTDGEIAHLNCNRVHRIEQQHLGWPDSTLKRFHM FERIADTLRQNSDFIVFFNANMVFLRDVGKEFLPTREQALVFHRHPGLFRRPAWLPYERRPESTAYIPYGSG SIYVCCGVNGGYTQPYLDFVAMLRRNIDIDVERGIIARWHDESHINRFVIGRHYKIGHPGVYPDRRNLPFPR IIRVIDKASVGGHTFLRGQTPEPAPEQSKTVAKLKRPCMPRAAQDEPIILARMMGGLGNQMFIYAA ARVLAERQGAQLHLDTGKLSGDSIRQYDLPAFSIDAPLWHIPCGCDRIVQAWFALRHVAAGCGMPKPTMQ VLRSGFHLDQRFFSIRHSAYLIGVWQSPHYWRGHEDRVRSSFDLTRFERPHLREALAAVSQPNTISVHLRRG DFRAPKNSDKHLLIDGSYYERARKLLLEMTPQSHFYIFSDEPEEAQRLFAHWENTSFQPPRRSQEEDLLLMSRC SASIIANSSFSWWGAWLGRPKQHVIAPRMWFTRDVLMHTYTLDLFPEKWILL | 241 |
| Roseburia sp. CAG:100 | WP_022518697.1 | 548374190 | protein [Roseburia sp. CAG:100] | 22.98 | | MILIHVMGGLGNQLYQLYALYEKMKSLGKKVKLDTYAYNDAAGEDKEMRSLELDRPPAIEYDKATSEDRTKLL DNSGLLTAKIRRKLLGRKDKTIRESKEYMPEIFHMDDVYLYGFWNCERYYEDIIPLLQDKLQFPISNNPRNQQ CIEQMQKENAVSIHIRRTDYLITVADGARYMGICTEDYYKGAMAYIERVSNPVYYIFSDDVEYAKQHYHQD NMHVDWNSKADSIYDMQLMSKCKHNICANSTFSMWAARLNQNEKIMIRPLHHDNYETTIATQVKQN WKNWILLDQNGQVCE | 242 |

TABLE 1-continued

| Bacterium names | Accession No. | GI No. | Gene name [bacterium] | % identity FutC | Alias | SEQUENCE | SEQ ID NO |
|---|---|---|---|---|---|---|---|
| Lachnospiraceae bacterium 10-1 | WP_022742385.1 | 550997676 | protein [Lachnospiraceae bacterium 10-1] | 22.96 | | MTMNIIRMSGGLGSQMFQYALYLKLKSMGKEVFDDINEYRGEKARPIMLAVFGIEYPRATWDEITSFTDG SMDLLKRLRRKIFGRKAIEYEBOQGFYDPNVLNFDSMYLRGNFQSEKYFQDIKEEVRKLYRFSTLEDMRLPERLY KATKACLDGISESSESVGLHMYRSDSVDGELYDGICTGNYYKGAVRFIQDKVPDAKFYIFSNEPKVVRGWVV DLIQSQIEGMSPSQVKEMEKRFVMVEANTEYTGYLDMMLMSKCKHNIISNSSFSWWSAWMNDHPEKV WWAPDRWSSDKEGNEIYTTGMTLVNEKGRVNYIHENSTVK | 243 |
| Prevotella nigrescens; Prevotella nigrescens F0103 | WP_004362670.1 | 490496500 | protein [Prevotella nigrescens] | 22.96 | | MILSYITGRLGNQLFEYAYARSLLLKRGKNELILNFSLVRAAGKEIEGFDNLRYFNVYSYTELDKDIVLSKGDL LQLFIYILFKLDQKLFRIIKEKWFSFFRRFGIIFQDYLDNISNLIIPRTKNVFCYGKYENPKYFDDIRSILLKEFTP PPLKNNDQLYSVIESTNSVCISIRRDFLCDKFKDRFLVCDKEYFLEAMEEAKKRISNSTFIFFSDDIEWVRENIH SDVPCYYESGKDPVWEKLRLMYSCKHFIISNSTFSWWAQLSRNEEKVVIAPDRWSNVPGEKSFLLSNSFIKI PIGILP | 244 |
| Bacteroides sp. CAG:875 | WP_022353235.1 | 547952493 | fucosyl-transferase [Bacteroides sp. CAG:875] | 22.95 | | MIYVEINGRLGNMFEIAAAKSLTDEVTLWCKGDWQLNCIKMYSDTLFKNYPIVVSLPNNIRIYEPEFTFHPI PYKENQDLLIKGYFQSYKYLDREKVLKLYPCPMPVVKLDIEKRFGDILSQYTVVSINVRGDYLNLPHRHPVGK KFLERAMLWFGDKVHYIISDDIEWCKAHKPQSTNINTQDLLPPEWMIEQCVYEPKVFLKALPLHAKYLLKRVLK NHPQKIVIAPHRWFGMSTNINTQDLLPPEWMIEQCVYEPKVFLKALPLHAKYLLKRVLK | 245 |
| Prevotella sp. oral taxon 299 str. F0039; Prevotella sp. oral taxon 299 | YP_008444280.1 | 532354444 | protein HMPREF0669_00176 [Prevotella sp. oral taxon 299 str. F0039] | 22.9 | | MDSQLLKHIKILSGGFGNQLFQYFGEYLKEKYNCSISFFSEPALDINQLOIHRFFPTLRISHNTELRRFHYAFTQ QLAYRCMRKLLLLFPFLNRKVKIENGSNYQNQSFNDTYCFDGYWQSYRYLSAFTPSLQFEDQLINDISADYIN AIEQSEAVFLHIRRGDYLNKENQKVFAECPLNYFENAVNKIKEGNKTYHFVFSNDIEWVCHLKLNNNEVTF IQNEGSSCDLKDFYLMTRCKHAIISNSTFSWWAAYLINNNDKKVIAPKRWYNDLSMNNATKDLIPPTWIRL | 246 |
| Paraprevotella xylaniphila; Paraprevotella xylaniphila YIT 11841 | WP_008628783.1 | 495904204 | alpha-1,2-fucosyl-transferase [Paraprevotella xylaniphila] | 22.87 | | MKIVCLKGGLGNQMFEYCRFRDLMDSGNGKVYLFYDRRRLKQHDGLRLSDCFELELPSCPWGIRLVVWGL KICRAIGVLKRLYLYDDEKPDAVLIDDYSQHRRFIPNARRYFSFRQFLAELQSGFVQMIRAVDYPVSVHVRRGDY LHPSNNSFVLCGVDYPRQAIAYVRKKRPDARFFFSDDMEWVRENLWMEDAVYVEHTELMPDYMDLYLM TLCRGHIISNSTFSFWGAYLAVDGNGMKIYPRRWFRDPTWITPPIFSEEWVGL | 247 |
| Dethiosulfovibrio peptidovorans; Dethiosulfovibrio peptidovorans DSM 11002 | WP_005658864.1 | 491897177 | glycosyl-transferase family 11 [Dethiosulfovibrio peptidovorans] | 22.84 | | MFQYAFPGRAIALDLGLDLKLDISNFGSDSRPFSLGIYSLTKNIPFGCYLSTSTRLKVMTKKLRRWGVWGMD KNMPGLVEPPPVLVSLDEVLSEKLSHLFVDGYWQSEKYFSRYSDVIRSDFRVIEESSAFLAWKKRMLSEPG GSISVHVRRGDYVTDSSANRVHGVLPIEYYLRAKEILNTISDGLVFVFTDDPVWARNNLCLGDKTIYVSGEDL KDYEELALMSCCDHHVVANSSFSWWGAWLGQDTSTVTIAPGRWFRKMDSSFVIPDNWIKIWT | 248 |
| Lachnospiraceae bacterium 10-1 | WP_016229292.1 | 510896192 | protein [Lachnospiraceae bacterium 10-1] | 22.83 | | MIIIQVMGLGNQLQQYALYRKFVRMGKEQRLDISWFLDKEKRGEVLAERELELDYFDRLIYETCTPEEKEQLI GSEGVAGKLKRKFLPGRIRWFHESKIYHPELLQMENMYLSGYFACEKYYADILYDLREKIQFPVNDHPKNIKM AQEMQERESVSVHLRRGDYLDEKNTAMFGNICTDAYYCKAIEYMKTLCSKPHFYIFSDDIPYVRQRFTGEEYT VVDINHGRDSFFDMWLMSRCRHNICANSTFSWGARLNSNDNKIMIRPTIHKNSQVFVKEEMEQLWPG WKFISPDGGIK | 249 |

TABLE 1-continued

| Bacterium names | Accession No. | GI No. | Gene name [bacterium] | % identity FutC | Alias | SEQUENCE | SEQ ID NO |
|---|---|---|---|---|---|---|---|
| Treponema maltophilum; Treponema maltophilum ATCC 51939 | WP_016525279.1 | 513872223 | protein [Treponema maltophilum] | 22.82 | | MFCAAFVEALKHAGQKVFVDTSLYNKGTVRSGIDPCHNGLETEHLFGIKFDEADKADVHRLSTSAEGLLNRIR RKYFTKKTHYIDTVFRYTPEVLSDKSDRYLEGFWQTEKYFLPIESDIRTLFRFRQPLSEKSAAVQSALQOEPAS LSASIHVRRGDFLHTKTLNVCTETYNNAIEYAAKYAVSAFYVFSDDIQWCREHLNFFGARSVFIDWNIGAD SWQDMVLMSMCRCNIIANSSFSWWAAWLNAASDKIVLAPAIWNRRQLEYADRYYGYDSDIPETWIRIP | 250 |
| Bacteroides massiliensis; Bacteroides massiliensis dnLKV3 | WP_016276676.1 | 511022363 | protein [Bacteroides massiliensis] | 22.79 | | MKLVSFTAGLGNQLFQYCFYRYLLNKFPNEKIYGYNKKWLKKHGGIIIEHFFDVKLPRSTRWINLYGQYLRIIY KCFSCGVSKDDDFEMNRTMFVGYWQDQCFFSGINISYKKNLVISEKNTWLLGEILKCNSVAIHFRRGDYMLP QFKKIPGEVCTVKYLKSIRKVEEKISEPVFVFSDDIDWKQNFTFNKVYFVDWNKGQNSFWDMYLMSQC SANIIANSTFSFWGAYLNKNNPFVIYPQKWVRTNLKQPNIFTKTWMAL | 251 |
| Enterococcus faecium; Enterococcus faecium DO; Enterococcus faecium EnGen0035 | YP_006376560.1 | 389869137 | family 11 glycosyltransferase [Enterococcus faecium DO] | 22.71 | | MTVLTLGGGLGNQMPGYGYARYIQKIHREKFIYINDSEVIKEADRPNSLGNLNTVNIKVLPRIISKPLNETERLV RKIMVRLFGVAGFNESAIFQSLNKFGIYYHPSVYKFYESLKTGPPIKIIEGGFQSWKYLETCPEIKQELRVKYEP MGENLRLLNLISQSESVCVHIRRGDYLSPKYKHLNVCDYQYYFESMNYIISKLNNPTFFIFSNTSDDLDWIKEN YSLPGKIVYVKNDNPDYEELRLMYSCKHFILLSNSTFSWAQYLSNNSGIVIAPEIWNRLNHDGIADLYMPNW ITMKVNR | 252 |
| Bacteroides; Bacteroides sp. 2_1_22; Bacteroides sp. 2_2_4; Bacteroides sp. D1; Bacteroides xylanisolvens SD CC 2a; Bacteroides xylanisolvens SD CC 1b; Bacteroides ovatus CAG:22 | WP_004313284.1 | 490442319 | glycosyltransferase family 11 [Bacteroides] | 22.67 | | MDVVIFNGLGNQMSQYAYYLAKKKVNPNTKVIFDIMSKHNHGYDLERAFGIEVNKTLLIKVLQIIYVLSRK FRLFKSVGVRTIYEPLNYDYTPLLMQKGPWGINYVVGGWHSEKNFMNVPDEVKKAFMFREQPNEDRFNE WLQVIRGDNSSVSVHIRRGDYMNIEPTGYYQLNGVATLDYYHEAIDYIRQVTPHFYVFSNDLDWCKEQF GVENFFYIECNQGVNSWRDMYLMSECHYHINANSTFSWWGAWLCKFEDSITVCPERFIRNVVTKDFYPER WHKIKSC | 253 |
| Synechococcus phage S-SM2 | YP_004322362.1 | 326781960 | glycosyltransferase family 11 [Synechococcus phage S-SM2] | 22.6 | | MIGFNALGRMGRLANQMFQYASLKGIARNTGVDFCVPYHEEAVNDGIGNMLRTEIFDSFDLQVNVGLLNK GHAPVVQERFFHFDEELFRMCPDHVDIRGYFQTEKYFKHIEDEIREDFTFKDEILNPCKEMIAGVDNPLALHV RRTDYVTNSANHPPCTLEYYEALLKHFDDDRNVIVFSDDPAWCKEQELFSDDRFMISENEDNRIDLCLMSLC DDFIIANSTYSWWGAWLSANKDKKVIAPVQWFGTGYTKDHKTSKLIPDGWTRIATA | 254 |
| Geobacter metallireducens; Geobacter metallireducens GS-15 | YP_006720295.1 | 404496189 | glycosyltransfer [Geobacter metallireducens GS-15] | 22.58 | | MDIHVLSYGLGNQLSYAQFFINRRQLMQRAYAFYAPKQHNGYELDRIFGLKEGLPWYLQFVRVFRLGISRR FYSKRITADFVLSFRIKVIDEAYNYEFDPSLLKPWFGIRILYGGWHDSRYPHPSEAAVRTAFSFPPLDDVNDAIL QOIDAVYGVSIHVRRGDYLKGINSNLFGGIATLEYYRNAIGWAITYCKHRSLEIKFYVFSDDIDWCKQNLGLR DAVYVSGNSKTDSEKDILLMSHCRANIIANSTFSWWAAWLNQQPNKVVICPTKFINTDSPNQTIYPAAWH QIEG | 255 |

TABLE 1-continued

| Bacterium names | Accession No. | GI No. | Gene name [bacterium] | % identity FutC | Alias | SEQUENCE | SEQ ID NO |
|---|---|---|---|---|---|---|---|
| 15; Geobacter metallireducens RCH3 | | | | | | | |
| Lachnospiraceae bacterium NK4A136 | WP_022780989.1 | 551037245 | protein [Lachnospiraceae bacterium NK4A136] | 22.58 | | MIIVRPHGGLGNQMFEYAFYRYMTNKYGADNVIGDMTWFDRNYSEHQGYELKKKVFDIDIPAIDYKTLAKIH EYYPRXYHRFAGLRYLSRMYAKYKNKHLKPTGEYIMDFGPSQYIHNDAPDKLDTNKDYYIEGVFCSDAYIKYYE NQIKKDLTFKPNYSQHTKDMLPKIEETNSVAIHVRRGDYVGNVFDIVTPDYYRQAVNYIRERVENPVFFVSD DMDYIKANFDFLGDFVPVHNCGKDSFQDMYLISRCCRHMIIANSSFSYFGALLGEKDSTIVIAPKKYKADEDLA LARENWVLL | 256 |
| Bacteroides coprophilus; Bacteroides coprophilus DSM 18228 = JCM 13818 | WP_008144634.1 | 495419937 | protein [Bacteroides coprophilus] | 22.56 | | MGFIVNMACGLANRMFQYSYYLFLKKQGYKVTVDFYRSAKLAHEKVAWNSIFPYAEIKQASRLKVFLWGGG SDLCSKVRRYFPSSTNVRTTTGAFDASLPANTARNEYIIGVFLNASIVEAVDDEIKKCFTFLPFTDEMNLRLKK EIEEECSVAIHVRKGKDYQSRIWYQNTSCMEYYRKAILQMKEKLQHSKFVFTDNVDWVKENFQEIDYTLVE GNPADGYGSHFDMQLMSLCKHNIISNSTYSWWSAFLNRNPEKVVIAPEIWFNPDSCDEFRSDRALCKGWI VL | 257 |
| Bacteroidetes; Capnocytophaga sp. oral taxon 329 str. F0087 Paraprevotella clara YIT 11840 | WP_008619736.1 | 495895157 | alpha-1,2-fucosyl-transferase [Bacteroidetes] | 22.53 | | MKIVCLKGGLGNQMFEYCRFRDLMESGHDEVYLFYDHRRLKQHNGLRLSDCFELELPSCPWGIKLVVWGLK ICRAVGVLKRLYLDDEKPEAVLIDDYSQHRRFIPNARRFFFRQFLAELQSGFVQMIRAVDYPVSVHVRRGDYL HPSNSSFGLCGVDYFQQAIAVRKKRPDARFFFSDDMEWVRENLWMEDAVYVEHTELLPDYVDLYLMTL CRGHHIISNSTFSFWGAYLAVDGNGMKIYPRRWFRDPTWTSPPIFSEEWVGL | 258 |
| Butyrivibrio sp. NC2007 | WP_022770361.1 | 551026242 | glycosyl-transferase [Butyrivibrio sp. NC2007] | 22.47 | | MLIIQIAGGLGNQMQQYAVYTKLREMGDKVKLDLSWFDPQVQKNMLAPREPELPIPGGTDYEECSDAYERD ALLKQGAFAAIAGKVLKKLGLRDEANPKVFSEKEMYHPEVPELEDKYIKGYFACQKYYGDIMDKLQEKFIPPE HSDPDLHARNMALVERMEREPSVSVHIRRGDYLDPSNVEILGNIATEQYYOGAMDYFTVKEPDTHFYIFTSD HEYAREKFSDESKYTIVDWNNGKNSVQDLMLMSHCKHNICANSTFSFWGARLNKRPDKTVIRTYKMRNN QPVNPQIMHDYWKGWILMDEKGSII | 259 |
| Paraprevotella xylaniphila; Paraprevotella xylaniphila YIT 11841 | WP_008628536.1 | 495903957 | glycosyl-transferase [Paraprevotella xylaniphila] | 22.45 | | MKIILVFTGGLGNQMFAYAYAFYLYLKRLFPQORFYGLYGKKLSEHYGLEIDKWFKVSLPRQPWVLPVTGLFYL YKQCVPNSKWLDLNQEICKNPRAVIFFPPKFTKKYIPDDNIWLEWKVDESGLSEKNRLLLSEIRSSDCCFVHVR RGDYLSPTFKSLFEGCCTLSYQRALKSMKEISPFVKVFCFSDDIQMVKQNLELGNRAVFWNSGTDSPLD MYLMSQCRYGIMANSTFSYWGARLGRKKKRIYYPQKWWNHGTGLPDIFPNTWVKI | 260 |
| Blautia hydrogenotrophica DSM 10507; Blautia; Blautia | WP_005944476.1 | 492742598 | protein [Blautia] | 22.44 | | HEIHVVLTGRLGNLFQYAFARHLQKEYGGKIICNIYELEHRSEKAAWPGKFNYEMSNYKLNDSILIEDIKLP WFADFSNPIIRIVKKVIPRIYFNLMASKGYLLWQKNSYINIPAIRNNEIIVNGMWQDVRFFHDVEAELSNEIVP TTKPISENEVLYNIAERENSCVSIRGGNYLVPKVKKLFVCDKEYFYNAIELLIKSKVRNAIFVSDDLEWKSYI KLEEKPFECKFYYESGKDTVEEKLRMTKCKHFIISNSSFSWWAQYLAKNENFIVIAPDAWFTNGDKNGLYI DDWILLPTQTKKM | 261 |

TABLE 1-continued

| Bacterium names | Accession No. | GI No. | Gene name | % identity FutC | Alias | SEQUENCE | SEQ ID NO |
|---|---|---|---|---|---|---|---|
| hydrogenotrophica CAG:147 | | | | | | | |
| Geobacter lovleyi; Geobacter lovleyi SZ | YP_001952981.1 | 189425804 | glycoside hydrolase family protein [Geobacter lovleyi SZ] | 22.44 | | MITVLNGGLGNQLFQYAAGRALABKHDVELLLDLSRLQHPKGDTPRCFELAPPNIKASLLAEEGRQPLGGSY QACMHRLLLKASIPLWGSIILKEQGCGFDPLIFRAPSCILDGFWQDECYFKQITSLLQQELSLKAPSPALRKAS SVLSDATVAVHVRRGDYVTNPAAASFKGICSQDYYQAAVANILTSYPDSQPLVFSDDPAWCQEHLDLGQPF RLAADPFGLNGSAEEELVLISRCAHQIIANSSFSWWGAWLNPSPHKLVVAPCRWFTPAITTNDLLPETWVRLP | 262 |
| Lachnospiraceae bacterium NK4A136 | WP_022781176.1 | 551037435 | protein [Lachnospiraceae bacterium NK4A136] | 22.41 | | MVISHLSGGFGNQLIYSYAFAYAVAKARKEELWIDTAIQDAPWFFRNPDILNLNIKYDKRVSYKIGEKKIDKIFN RINFRNAIGWNTKIINESDMPNIDDWFDTCVNQKGNIYIKGNWSYEKLFISVKQEIIDMTFKNELSKEANDI AQDINSQETSVHIHYRLGDVKIGINIVPDYFIASAMTSMVEKYGNPVFYSFSEDNDWVKKQFEGLPYNIKYVE YSSDDKGLEDFRLYSMCKHQIASNSSYSWWGAYLNNNPNKYIIAPTDYNGGWKSEIYPKHWDVRPEFLK | 263 |
| Bacteroides vulgatus; Bacteroides vulgatus PC510 | WP_005840359.1 | 492426440 | glycosyl-transferase family 11 [Bacteroides vulgatus] | 22.37 | | MFHYKFLLFGGGLGNQIFEYFYYLMLRKKYPNIVFLGCYRKASFKAHNGLEISDVFDVDLPNDGGLSGRFISYV LSVLSRIIPSLSMKANTEYSSKYLLINAYQPNLLFYLNEEKIKFRPFKLDEVNRRLLNSIKMESSVSIHVRRGDYLF GQYRDIYSNICTLAYYQKAVDKCKGILESPRFFVFSDDIEWARDVFVGREYEFVSNNIGKNSFIDMFLMSNCKI QIIANSTFSYWAAYLSNSLVKIYPAKWINGIERPNIFPDNWIGL | 264 |
| Planctomyces brasiliensis; Planctomyces brasiliensis DSM 5305 | YP_004271766.1 | 325110698 | glycosyl-transferase family protein [Planctomyces brasiliensis DSM 5305] | 22.37 | | MIIARIENGLGNQLFKYAAGRALSKHRTSLYTIPGSVRKPHETFIILSKYFNVQAKSVSPFLLQTGRLRLLKGYE NHSFGFDPRFETTRNNTVVSGNFQSARYFLPFFDQINRELTLKPEVVDGLESVYPHVLESLRTPNSVVNHIRLG DYVSSGYDICGPEYYAKAISRLQQLGHELRAFVFSDTPQAASRFLPADIDAQIMSEFPEVRDAARSLTVERSTI RDYFLMQQCRHFVIPSNNFSYWAALLSSSDGDVIYPNRWYIDIDTSPRDLGLAPAEWTPIPLT | 265 |
| Butyrivibrio sp. AE2015 | WP_022772730.1 | 551028648 | glycosyl transferase [Butyrivibrio sp. AE2015] | 22.36 | | MIILQIAGGLGNQMQQYALRKLLKCCGKTVKLDLSWFGPEIQKNMLAPFEFELVLFDLPFEICTKEEFDALIK QNLFQKIAGKVSQKLGKSASSNAKVFVETMHEEIFDLDDVYITGYFACQYYDDVMAELQDLFVPPSHSIP ELDQRNAVLASKMEKENSVSVHIRRGDYLSPENVGILGNIASDKYYESAMNYFLEKDENTHFYIFTNDHEYAR EHYSDESRYTIIDWNTGKNSLQDLMSHCKGNICANSTFSWGARLNKRPDRELVRTLKMRNNQEAQPEI MHEYWKNWILIDENGVIV | 266 |
| Roseovarius nubinhibens ISM; Roseovarius nubinhibens | WP_009813856.1 | 497499658 | alpha-1,2-fucosyl-transferase [Roseovarius nubinhibens] | 22.34 | | MTDTPPPSQVITSRLFGGAGNQLFQYAAGRALADRLGCDLMIDARYVAGSRDGDCFTHFAKARLRRDVA LPPAKSDGPLYRALWNRKFGRSPRFHRERGLGVDPEFFNLPRGTYHGVWQSEQYFGPDTDALRRDLTLTTAL DAPNAAMAAQIDAAPCPVSFHVRRGDYIAAGAYAACTPDYYRAAADHLATTLGKPLTCFIPSNDPAWARD NLDLGQDQVIVDLNDEATGHFDMALMARCAHHVIANSTFSWWGAWLNPDDPKLVVAPRNWFATQALH NPDLIPEQWHRL | 267 |
| Eubacterium sp. CAG:581 | WP_022505071.1 | 548315094 | protein [Eubacterium sp. CAG:581] | 22.33 | | MIEVNIVGQLGNQMFEYACARQLQKKYGGEIVLNTYEMRKETPNKFLSIILDYKSENDVKIISDKPLSSANANN YLVKIMRQYFPNWYFNFMAKRGTFWKSARKYKELPELNEQLSKHIVLNGYWQCDKYFNDVVDTIREDFTP KYPLKAENEQQLEKIKSTESVSVTIRRGDFWNEKNDTFYICDDDYFNKALSKIKELCPDCTFGFSDDVWEIKK NVNFPGEVYFESGNDPVWEKLRLMSACKHFVLSNSSFSWWAQYLSDNNNKIVVAPDIWYKTDGPKKTALY QDGWNLIHIGD | 268 |

TABLE 1-continued

| Bacterium names | Accession No. | GI No. | Gene name [bacterium] | % identity FutC | Alias | SEQUENCE | SEQ ID NO |
|---|---|---|---|---|---|---|---|
| Providencia alcalifaciens | AFH02807.1 | 383289327 | glycosyl-transferase [Providencia alcalifaciens] | 22.26 | | MKINGKESSMKIQKKIISHLIGGLGNQLFQYATSYALAKENNAKIVIDDRLFKYKHGGYRLDKLNIIGEKISS IDKLLFPLILCKLSQKENFIPKSTKKFILEKKTSSPKYLTFSDKEHTKMLIGYWQNAIYPQKYFSELKEMVPLDIS QEQLDLSIQHAQQSVALHVRGDYISNKNALAMHGICSIDYYKNSIQHINAKLEKPFFYIFSNDKLWCEENLT PLFDGNFHIVENNSQEIDLWLISQCQHHIIANSTFSWWGAWLANSDSQIVITPDPWFNKEIPIPSPVLSHWL KLKK | 269 |
| Salmonella enterica | AFW04804.1 | 411146173 | glycosyl-transferase [Salmonella enterica] | 22.26 | | MFSCLSGGLGNQMFQYSAAYILKKNICHAQLIIDDSYFYCQPQKDTPRNFEINQFNIVFDRVTTDEKRAISKL RKFKKKIPLPLFKSNVITEFLFGKSLLTDEDFYKVLKKNQFTVKMNACLFSLYQDSSLINKYRDLILPLFTINDELLQ VCQQLDSYGFICEHTNTTSLHIRRGDYVTNPHAAKGHGTLSMNYYSQAMNYVDHKLGKQLFIIFSDDVQWA AEKFPGGRSDCYIVNNVNCQFSAIDMYLMSLCNNNIIANSTYSWWGAWLNKSEEVLVIAPRKWFAEDKESLL AVNDWISI | 270 |
| Sulfurospirillum deleyianum; Sulfurospirillum deleyianum DSM 6946 | YP_003304829.1 | 268680398 | protein Sdel_1779 [Sulfurospirillum deleyianum DSM 6946] | 22.18 | | MIIIKIMGGLASQLHYSVGRALSLKYNTELKLDIFWFDNISGSGTIREYHLDKYNVVAKIATEQEIKQPKPNKY LLKINNLFQKFTNWKINYRNYCNESFISLENPNLLPDNIVEGEWSDRYFSHIKEILQKELTLKSEYMDSTNHF LAKQSSDFAHDDNASKLHCTCSLEYYKKALQYISKNLLKMLLIFSDLDWLKPNFNFLDNVEFEVEGFQDY EEFHLMTLSKHNIIANSGFSLFFAWLNINHNKIIISLSEWVFEEKLNKYIIDNIKDKNILFLENLE | 271 |
| Pseudovibrio sp. FO-BEG1 | YP_005080114.1 | 374329930 | alpha-1,2-fucosyl-transferase [Pseudovibrio sp. FO-BEG1] | 22.15 | | MSVASQVRISGAARRRKLKPTLIVIRGGIGNQLFQYALGRKIALETGMKLRFDRSEYDQYFNRSYCLNLFKT QGLSATESEMSAVLWPAQSFGQTVKLCRKFYPFYQRRYIREDELLQDSETPVLKQSAYLDGYWQTWEIPFSI MEQLRDEITLKKPMVLERLKLLQRIKSGPSAALHVRGDYSQAHNLQNFGLCSAGYYKGAMDFLTERVPGLT FYVFSDSPERAREVVPQQENVYFSDPMQDGKDHEDLMVMSSCDHIVTANSTFSWWAAFLNGNEDKHVIA PLKWFKNPNLDDLIVPPHWQRL | 272 |
| Prevotella sp. oral taxon 472 str. F0295; Prevotella sp. oral taxon 472 | WP_009236633.1 | 496529942 | alpha-1,2-fucosyl-transferase [Prevotella sp. oral taxon 472] | 22.11 | | MKIVCIKGGLGNQLFEYCRYHGLLRQHNNHGVYLHYDRRRTKQHGGVWLDKAFLITLPTEPWRVKLMVM ALKMLRKLHLFKRLYREDDPRAVLIDDYSQHKQFITNAAEILNFRPFAQLDYVDEITSEPPAVSVHVRRGDYLL PANKANFGVCSVHYYLSAAVAVRERHPDARFPVFSDDIEWAKMNLNLNPNCVFVEHAQPQPDHADLYLMSL CKGHIIANSTPSFWGAYLSMGSSAIAIYPKQWFAEFTWNAPDIFLGHWIAL | 273 |
| Butyrivibrio fibrisolvens | WP_022752732.1 | 551008155 | glycosyl-transferase [Butyrivibrio fibrisolvens] | 22.08 | | MLIIRVAGGLGNQMQOYAMYRKLKSLGKEVKLDLSWFDVENQEGQLAPRKCELKYPDGVFDEECTDAERA YFTKRSILTKALNKVFPATCKIFEETEMFHPEIYSFKDKYLEFYFLCNKYTDDILPFIQNEIVPKHSDPMQKRN EELMERMDGWHTASIHLRRGDYITEPQNEALFGNIATDAYDAAIRYVLDKDYQTHFYIFSNDPEYAREHYS DESRYTIVTGNDGDNSLLDMELMSHCRYNICANSTPSFWGARLNKRSDKEMIRTFKMRNNQEVTAREMTD YWKDWILIDEKGNRIF | 274 |
| Lewinella persica | WP_020571066.1 | 522059857 | protein [Lewinella persica] | 22.04 | | MVISRLHSGLGNQMFQYAFARRIQLQLNVKLRIDLSILLSRPPDGYIKREYDLDIFKLSPAYHCNPTSLRILYA PGKYRWSQVVRDLARKGYPVMEKSFSVDNTLLDSPPDNVIYQGVWQSERYFSEVANTIRKDFAFQHSIQP QSESLAREIRKEDSVCLNIRRKDYLASPTHNVTDETYYENCIQQMRERFSSGARFLFSDDLVWCREFFAHFHD VVIVGHDHAGPKFGNYLQLMAQCHHYIIPNSTFAWWAAWLGERTGSVIMAPERWFGTDEFGYRDVVPER WLKVPN | 275 |

Other Embodiments

While the invention has been described in conjunction with the detailed description thereof, the foregoing description is intended to illustrate and not limit the scope of the invention, which is defined by the scope of the appended claims. Other aspects, advantages, and modifications are within the scope of the following claims.

The patent and scientific literature referred to herein establishes the knowledge that is available to those with skill in the art. All United States patents and published or unpublished United States patent applications cited herein are incorporated by reference. All published foreign patents and patent applications cited herein are hereby incorporated by reference. Genbank and NCBI submissions indicated by accession number cited herein are hereby incorporated by reference. All other published references, documents, manuscripts and scientific literature cited herein are hereby incorporated by reference.

While this invention has been particularly shown and described with references to preferred embodiments thereof, it will be understood by those skilled in the art that various changes in form and details may be made therein without departing from the scope of the invention encompassed by the appended claims.

SEQUENCE LISTING (292 sequences)

SEQ ID NO: 1 - protein, 300 aa, Helicobacter pylori
MAFKVVQICGGLGNQMFQYAFAKSLQKHSNTPVLLDITSFDWSDRKMQLELFPINLPYASAKEIAIAKMQHLPKLVRDALKCMGFDRVSQEIVFEYEPELLKPSRLTYFYGYFQDPRYFDAISPLIKQTFTLPPPPENNKNNNKKEEEYHRKLSLILAAKNSVFVHIRRGDYVGIGCQLGIDYQKKALEYMAKRVPNMELFVFCEDLEFTQNLDLGYPFMDMTTRNKEEEAYWDMLLMQSCQHGIIANSTYSWWAAYLIENPEKIIIGPKHWLFGHENILCKEWVKIESHFEVKSQKYNA

SEQ ID NO: 2 - protein, 286 aa, Helicobacter mustelae
MDFKIVQVHGGLGNQMFQYAFAKSLQTHLNIPVLLDTTWFDYGNRELGLHLFPIDLQCASAQQIAAAHMQNLPRLVRGALRRMGLGRVSKEIVFEYMPELFEPSRIAYFHGYFQDPRYFEDISPLIKQTFTLPHPTEHAEQYSRKLSQILAAKNSVFVHIRRGDYMRLGWQLDISYQLRAIAYMAKRVQNLELFLFCEDLEFVQNLDLGYPFVDMTTRDGAAHWDMMLMQSCKHGIITNSTYSWWAAYLIKNPEKIIIGPSHWIYGNENILCKDWVKIESQFETKS

SEQ ID NO: 3 - protein, 281 aa, Bacteroides vulgatus
MRLIKVTGGLGNQMFIYAFYLRMKKYYPKVRIDLSDMMHYKVHYGYEMHRVFNLPHTEFCINQPLKKVIEFLFFKKIYERKQAPNSLRAFEKKYFWPLLYFKGFYQSERFFADIKDEVRESFTFDKNKANSRSLNMLEILDKDENAVSLHIRRGDYLQPKHWATTGSVCQLPYYQNAIAEMSRRVASPSYYIFSDDIAWVKENLPLQNAVYIDWNTDEDSWQDMMLMSHCKHHIICNSTFSWWGAWLNPNMDKTVIVPSRWFQHSEAPDIYPTGWIKVPVS

SEQ ID NO: 4 - protein, 297 aa, Escherichia coli
MSIIRLQGGLGNQLFQFSFGYALSKINGTPLYFDISHYAENDDHGGYRLNNLQIPEEYLQYYTPKINNIYKLLVRGSRLYPDIFLFLGFCNEFHAYGYDFEYIAQKWKSKKYIGYWQSEHFFHKHILDLKEFFIPKNVSEQANLLAAKILESQSSLSIHIRRGDYIKNKTATLTHGVCSLEYYKKALNKIRDLAMIRDVFIFSDDIFWCKENIETLLSKKYNIYYSEDLSQEEDLWLMSLANHHIIANSSFSWWGAYLGSSASQIVIYPTPWYDITPKNTYIPIVNHWINVDKHSSC

SEQ ID NO: 5 - protein, 293 aa, Helicobacter bilis
MGDYKIVELTCGLGNQMFQYAFAKALQKHLQVPVLLDKTWYDTQDNSTQFSLDIFNVDLEYATNTQIEKAKARVSKLPGLLRKMFGLKKHNIAYSQSFDFHDEYLLPNDFTYFSGFFQNAKYLKGLEQELKSIFYYDSNNFSNFGKQRLELILQAKNSIFIHIRRGDYCKIGWELGMDYYKRAIQYIMDRVEEPKFFIFGATDMSFTEQFQKNLGLNENNSANLSEKTITQDNQHEDMFLMCYCKHAILANSSYSFWSAYLNNDANNIVIAPTPWLLDNDNIICDDWIKISSK

SEQ ID NO: 6 - protein, 283 aa, Escherichia coli
MEVKIIGGLGNQMFQYATAFAIAKRTHQNLTVDISDAVKYKTHPLRLVELSCSSEFVKKAWPFEKYLFSEKIPHFMKKGMFRKHYVEKSLEYDPDIDTKSINKKIVGYFQTEKYFKEFRHELIKEFQPKTKFNSYQNELLNLIKENDTCSLHIRRGDYVSSKIANETHGTCSEKYFERAIDYLMNKGVINKKTLLFIFSDDIKWCRENIFFNNQICFVQGDAYHVELDMLLMSKCKNNIISNSSFSWWAAWLNENKNKTVIAPSKWFKKDIKHDIIPESWVKL

SEQ ID NO: 7 - protein, 281 aa, Vibrio cholerae
MIVMKISGGLGNQLFQYAVGRAIAIQYGVPLKLDVSAYKNYKLHNGYRLDQFNINADIANEDEIFHLKGSSNRLSRILRRLGWLKKNTYYAEKQRTIYDVSVFMQAPRYLDGYWQNEQYFSQIRAVLLQELWPNQPLSINAQAHQIKIQQTHAVSIHVRRGDYLNHPEIGVLDIDYYKRAVDYIKEKIEAPVFFVFSNDVAWCKDNFNFIDSPVFIEDTQTEIDDLMLMCQCQHNIVANSSFSWWAAWLNSNVDKIVIAPKTWMAENPKGYKWVPDSWREI

SEQ ID NO: 8 - protein, 289 aa, Bacteroides fragilis
MIVSSLRGGLGNQMFIYAMVKAMALRNNVPFAFNLTTDFANDEVYKRKLLLSYFALDLPENKKLTFDFSYGNYYRRLSRNLGCHILHPSYRYICEERPPHFESRLISSKITNAFLEGYWQSEKYFLDYKQEIKEDFVIQKKLEYTSYLELEEIKLLDKNAIMIGVRRYQESDVAPGGVLEDDYYKCAMDIMASKVTSPVFFCFSQDLEWVEKHLAGKYPVRLISKKEDDSGTIDDMFLMMHFRNYIISNSSFYWWGAWLSKYDDKLVIAPGNFINKDSVPESWFKLNVR

SEQ ID NO: 9 - protein, 290 aa, Escherichia coli
MSIVVARLAGGLGNQMFQYAKGYAESVERNSYLKLDLRGYKNYTLHGGFRLDKLNIDNTFVMSKKEMCIFPNFIVRAINKFPKLSLCSKRFESEQYSKKINGSMKGSVEFIGFWQNERYFLEHKEKLREIFTPININLDAKELSDVIRCTNSVSVHIRRGDYVSNVEALKIHGLCTERYYIDSIRYLKERFNNLVFFVFSDDIEWCKKYKNEIFSRSDDVKFIEGNTQEVDMWLMSNAKYHIIANSSFSWWGAWLKNYDLGITIAPTPWFEREELNSFDPCPEKWVRIEK

SEQ ID NO: 10 - protein, 288 aa, Prevotella melaninogenica
MKIVKILGGLGNQMFQYALYLSLQESFPKERVALDLSSFHGYHLHNGFELENIFSVTAQKASAADIMRIAYYYPNYLLWRIGKRFLPRRKGMCLESSSLRFDESVLRQEGNRYFDGYWQDERYFAAYREKVLKAFTFPAFKRAENLSLLEKLDENSIALHVRRGDYVGNNLYQGICDLDYYRTAIEKMCAHVTPSLFCIFSNDITWCQQHLQPYLKAPVVYVTWNTGVESYRDMQLMSCCAHNIIANSSFSWWGAWLNQNREKVVIAPKKWLNMEECHFTLPASWIKI

SEQ ID NO: 11 - protein, 265 aa, Clostridium bolteae
MFQYALYKAFEQKHIDVYADLAWYKNKSVKFELYNFGIKINVASEKDINRLSDCQADFVSRIRRKIFGKKKSFVSEKNDSCYENDILRMDNVYLSGYWQTEKYFSNTREKLLEDYSFALVNSQVSEWEDSIRNKNSVSIHIRRGDYLQGELYGGICTSLYYAEAIEYIKMRVPNAKFFVFSDDVEWVKQQEDFKGFVIVDRNEYSSALSDMYLMSLCKHNIIANSSFSWWAAWLNRNEEKIVIAPRRWLNGKCTPDIWCKKWIRI

SEQ ID NO: 12 - protein, 289 aa, Lachnospiraceae bacterium 3_1_57FAA_CT1
MVIVQLSGGLGNQMFEYALYLSLKAKGKEVKIDDVTCYEGPGTRPRQLDVFGITYDRASREELTEMTDASMDALSRVRRKLTGRRTKAYRERDINFDPLVMEKDPALLEGCFQSDKYFRDCEGRVREAYRFRGIESGAFPLPEDYLRLEKQIEDCQSVSVHIRRGDYLDESHGGLYTGICTEAYYKEAFARMERLVPGARFFLFSNDPEWTREHFESKNCVLVEGSTEDTGYMDLYLMSRCRHNIIANSSFSWWGAWLNENPEKKVIAPAKWLNGRECRDIYTERMIRL

SEQ ID NO: 13 - protein, 295 aa, Methanosphaerula palustris
MIIVRLKGGLGNQLSQYALGRKIAHLHNTELKLDTTWFTTISSDTPRTYRLNNYNIIGTIASAKEIQLIERGRAQGRGYLLSKISDLLTPMYRRTYVRERMHTFDKAILTVPDNVYLDGYWQTEKYFKDIEEILRREVTLKDEPDSINLEMAERIQACHSVSLHVRRGDYVSNPTTQQFHGCCSIDYYNRAISLIEEKVDDPSFFIFSDDLPWAKENLDIPGEKTFVAHNGPEKEYCDLWLMSLCQHHIIANSSFSWWGAWLGQDAEKMVIAPRRWALSESFDTSDIIPDSWITI

SEQ ID NO: 14 - protein, 287 aa, Tannerella sp. CAG:118
MVRIVEIIGGLGNQMFQYAFSLYLKNKSHIWDRLYVDIEAMKTYDRHYGLELEKVFNLSLCPISNRLHRNLQKRSFAKHFVKSLYEHSECEFDEPVYRGLRPYRYYRGYWQNEGYFVDIEPMIREAFQFNVNILSKKTKAIASKMRRELSVSIHVRRGDYENLPEAKAMHGGICSLDYYHKAIDFIRQRLDNNICFYLFSDDINWVEENLQLENRCIIDWNQGEDSWQDMYLMSCCRHHIIANSSFSWWAAWLNPNKNKIVLTPNKWFNHTDAVGIVPKSWIKIPVF

SEQ ID NO: 15 - protein, 289 aa, Bacteroides caccae
MKIVKILGGLGNQMFQYALFLSLKERFPHEQVMIDTSCFRNYPLHNGFEVDRIFAQKAPVASWRNILKVAYPYPNYRFWKIGKYILPKRKTMCVERKNFSFDAAVLTRKGDCYYDGYWQHEEYFCDMKETIWEAFSFPEPVDGRNKEIGALLQASDSASLHVRRGDYVNHPLFRGICDLDYYKRAIHYMEERVNPQLYCVFSNDMAWCESHLRALLPGKEVVYVDWNKGAESYVDMRLMSLCRHNIIANSSFSWWGAWLNRNPQKVVVAPERWMNSPIEDPVSDKWIKL

SEQ ID NO: 16 - protein, 290 aa, Butyrivibrio sp. AE2015
MIIIQLKGGLGNQMFQYALYKSLKKRGKEVKIDDKTGFVNDKLRIPVLSRWGVEYDRATDEEIINLTDSKMDLFSRIRRKLTGRKTFRIDEESGKFNPEILEKENAYLVGYWQCDKYFDDKDVVREIREAFEKKPQELMTDASSWSTLQQIECCESVSLHVRRTDYVDEEHIHIHNICTEKYYKNAIDRVRKQYPSAVFFIFTDDKEWCRDHFKGPNFIVVELEEGDGTDIAEMTLMSRCKHHIIANSSFSWWAAWLNDSPEKIVIAPQKWINNRDMDDIYTERMTKIAL

SEQ ID NO: 17 - protein, 282 aa, Prevotella sp. CAG:891
MRLVKMIGGLGNQMFIYAFYLQMRKRFSNVRIDLTDMMHYNVHYGYELHKVFGLPRTEFCMNQPLKKVLEFLFFRTIVERKQHGRMEPYTCQYVWPLVYFKGFYQSERYFSEVKDEVRECFTFNPALANRSSQQMMEQIQNDPQAVSIHIRRGDYLNPKHYDTIGCICQLPYYKHAVSEIKKYVSNPHFYVFSEDLDWVKANLPLENAQYIDWNKGADSWQDMMLMSCCKHHIICNSTFSWWAAWLNPSVEKTVIMPEQWTSRQDSVDFVASCGRWVRVKTE

SEQ ID NO: 18 - protein, 281 aa, Parabacteroides johnsonii
MRLIKMIGGLGNQMFIYAFYLKMKHHYPDTNIDLSDMVHYKVHNGYEMNRIFDLSQTEFCINRTLKKILEFLFFKKIYERRQDPSTLYPYEKRYFWPLLYFKGFYQSERFFFDIKDDVRKAFSFNLNIANPESLELLKQIEVDDQAVSIHIRRGDYLLPRHWANTGSVCQLPYYKNAIAEMENRITGPSYYVFSDDISWVKENIPLKKAVYVTWNKGEDSWQDMMLMSHCRHHIICNSTFSWWGAWLNPRKEKIVIAPCRWFQHKETPDMYPKEWIKVPIN

SEQ ID NO: 19 - protein, 290 aa, Akkermansia muciniphila
MRLFGGLGNQLFQYAFLFALSRQGGKARLETSSYEHDDKRVCELHHFRVSLPIEGGPPPWAFRKSRIPACLRSLFAAPKYPHFREEKRHGFDPGLAAPPRRHTYFKGYFQTEQYFLHCREQLCREFRLKTPLTPENARILEDIRSCCSISLHIRRTDYLSNPYLSPPPLEYYLRSMAEMEGRLRAAGAPQESLRYFIFSDDIEWARQNLRPALPHVHVDINDGGTGYFDLELMRNCRHHIIANSTFSWWAAWLNEHAEKIVIAPRIWFNREEGDRYHTDDALIPGSWLRI

SEQ ID NO: 20 - protein, 298 aa, Salmonella enterica
MYSCLSGGLGNQMFQYAAAYILKQYFQSTTLVLDDSYYYSQPKRDTVRSLELNQFNISYDRFSFADEKEKIKLLRKFKRNPFPKQISEILSIALFGKYALSDRAFYTFETIKNIDKACLFSFYQDADLLNKYKQLILPLFELRDDLLDICKNLELYSLIQRSNNTTALHIRRGDYVTNQHAAKYHGVLDISYYNHAMEYVERERGKQNFIIFSDDVRWAQKAFLENDNCYVINNSDYDFSAIDMYLMSLCKNNIIANSTYSWWGAWLNKYEDKLVISPKQWFLGNNETSLRNASWITL

SEQ ID NO: 21 - protein, 281 aa, Bacteroides sp. CAG:633
MRLIKMTGGLGNQMFIYAFYLRMKKRYPKVRIDLSDMVHYHVHHGYEMHRVFNLPHTEFCINQPLKKVIEFLFFKKIYERKQDPNSLRAFEKKYLWPLLYFKGFYQSERFFADIKDEVRKAFTFDSSKVNARSAELLRRLDADANAVSLHIRRGDYLQPQHWATTGSVCQLPYYQNAIAEMNRRVAAPSYYVFSDDIAWVKENIPLQNAVYIDWNKGEESWQDMMLMSHCRHHIICNSTFSWWGAWLDPHEDKIVIVPNRWFQHCETPNIYPAGWVKVAIN

SEQ ID NO: 22 - protein, 318 aa, Clostridium sp. CAG:306
MEKIKIVKLQGGMGNQMFQYAFGKGLESKFGCKVLFDKINYDELQKTIINNTGKNAEGICVRKYELGIFNLNIDFATAEQIQECIGEKLNKACYLPGFIRKIFNLSKNKTVSNRIFEKKYGEYDEEILKDYSLAYYDGYFQNPKYFEDISDKIKKEFTLPEIKNHDIYNKKLLEKITQFENSVFIHVRRDDYLNINCEIDLDYYQKAVKYILKHIENPKFFVFCAEDPDYIKNHFDIGYDFELVGENNKTQDTYYENMRLMMACKHAIIANSSYSWWAAWLSDYDNKIVIAPTPWLPGISNEIICKNWIQIKRGISNE

SEQ ID NO: 23 - protein, 288 aa, Prevotella sp. oral taxon 306
MKIVKILGGLGNQMFQYALYLSLQESFPKERVALDLSCFNGYHLHNGFELERIFSLTAQKASAATIMRIAYYYPNYLLWRIGKRLLPRRKTMCLESSTFRYDESVLTREGNRYFDGYWQDERYFVACREKVLKAFTFPAFKRTENLSLLRKLDKNSVAIHVRRGDYIGNQLYQGICDLDYYRAAIDKISTYVTPSVFCIFSNDIAWCQTHLQPYLKAPVVYVTWNTGTESYRDMQLMSCCAHNIIANSSFSWWGAWLNQNNEKVVIAPKRWLNMDDCQFPLPASWVKI

SEQ ID NO: 24 - protein, 268 aa, Brachyspira sp. CAG:484
MQLVKLMGGLGNQMFQYAFAKALGDKNILFYGDYKKHSLRKVELNRFKCKAVYIPRELFKYLKFVFTKFDKIEYMRSGIYVPEYLNRDGNHIYIGFWQTEKYFKQIRPRLLKDFTPRKKLDRENAGIISKMQQINSVSVHIRRTDYVDESHIYGDTNLDYYKRAIEYISSKIENPEFFFFSDDMAYVKEKFAGLKFPHSFIDINSGNNSYKDLILMKNCKHNIIANSTFSWWGAWLNENEEKIVIAPAKWFVTGENDKDIVPDEWIKL

SEQ ID NO: 25 - protein, 292 aa, Thalassospira profundimaris
MVIVKLLGGLGNQMFQYATGRAVASRLDVELLLDVSAFAHYDLRRYELDDWNITARLATSEELARSGVTAAPPSFFDRIARFLRIDLPVNCFREASFTYDPRILEVSSPVYLDGYWQSERYFLDIEKKLRQEFQLKASIDANNHSFKKKIDGLGKQAVSLHVRRGDYVTNPQTASYHGVCSLDYYRAAVDYIAEHVSDPCFFVFSDDLEWVQTNLNIKQPIVLVDANGPDNGAADMALMMACRHHIIANSSFSWWGSWLNPLNDKIIVAPKKWFGRANHDTTDLVPDSWVRL

SEQ ID NO: 26 - protein, 308 aa, Acetobacter sp. CAG:267
MAVSPQESKYSAHVSPDKPLRIVRLGGGLGNQMFQYAFGLAAGDVLWDNTSFLTNHYRSFDLGLYNISGDFASNEQIKKCKNEIRFKNILPRSIRKKFNLGKFIYLKTNRVCERQINRYEPELLSKDGDVYYDGVFQTEKYFKPLRERLLHDFTLTKPLDAANLDMLAKIRAADAVAVHIRRGDYLNPRSPFTYLDKDYFLNAMDYIGKRVDKPHFFIFSSDTDWVRTNIQTAYPQTIVEINDEKHGYFDLELMRNCRHNIIANSTFSWWGAWLNTNPDKIVVAPKQWFRPDAAEYSGDIVPNDWIKL

SEQ ID NO: 27 - protein, 291 aa, Dysgonomonas mossii
MVTVLLSGGLGNQMFQYAAAKSLAIRLNTALSVDLYTFSKKTQATVRPYELGIFNIEDVVETSSLKAKAVIKARPFIQRHRSFFQRFGVFTDTYAILYQPTFEALTGGVIMSGYFQNESYFKNISELLRKDFSFKYPLIGENKDVAGQISENQSVAVHIRRGDYLNKNSQSNFAILEKDYYEKAINYISAHVKNPEFYVFSEDFDWIKDNLNFKEFPVTFIDWNKGKDSYIDMQLMSLCKHNIIANSSFSWWSAWLNNSEERKIVAPERWFVDEQKNELLDCFYPQGWIKI

SEQ ID NO: 28 - protein, 287 aa, Clostridium sp. KLE 1755
MIIIEISGGLGNQMFQYALGQKFISMGKEVKYDLSFYNDRVQTLRQFELDIFDLDCPVASNSELSRFGKGNSLKSRLKQKLGWDKEKIYEENLDLGYQPRIFELDDIYLSGYWQSELYFKDIREQILRLYTFPIQLDYMNGVFLRKIENSNSVSIHIRRGDYLNENNLKIYGNICTLNYYNKALQIIAKKITNPIIFVFTNDIEWVRKELEIPNMVIVDCNSGKLSYWDMYLMSKCKANIVANSSFSWWGAWLNKNENRIIISPKRWLNNHEQTSTLCDNWIRCGDD

SEQ ID NO: 29 - protein, 301 aa, Gillisia limnaea
MFISKNTVIIKLVGGLGNQMFQFAIAKIIAEKEKSEVLVDITFYTELTENTKKFPRHFSLGIFNSSFAIASKKEIDYFTKLSNFNKFKKKLGLNYPTIFHESSFNFKAQVLELKAPIYLNGYFQSFRYFLGKEYVIRKIFKFPDEALDKDNDNIKRKIIGKTSVSLHIRRGDYVNNKKTQQFHGNCTIDYYQSAIAYLSSKLTDFNLIFFSDDIHWVRQQFKNISNQKIYVSGNLNHNSWKDMYLMSLCDHNIIANSSFSWWGAWLNKNPEKIIIAPKRWFADTEQDKNSIDLIPSEWYRI

SEQ ID NO: 30 - protein, 288 aa, Methylotenera mobilis
MLVSRIIGGLGNQMFEYAAARAASLRISVQLKLDLSGFETYDLHAYGLNNFNIVEDVAKKDDYFIGAPESLLKKIKKYLRGLIQLESFRESDLSFDSKVLELNDNTYLDGYWQCERYFIDFDKQIRQDFSFKFAPDALNQRYLELIDSVNAVSVHIRRGDYVSNSTTNEIHGVCDLDYYQRAAEFMRARIGPENLHFFVFSDDTDWVKENISFGSDTTFISHNDAAKNYEDMRLMSACKHHIIANSSFSWWAAWLNPSKQKVVIAPRQWFKSTLLNSDDIVPASWVRL

SEQ ID NO: 31 - protein, 287 aa, Runella slithyformis
MIIVKLSGGLGNQLFQYAFGRHLATVNQKELKLDTSALTKTSDWTNRSYALDAFNIRAQEATPEEIKALAGKPNRLLQRVGRKVGITPIQYFQEPHFHFYSSALSIKSSHYLEGYWQSEKYFEAITPILREEFAFTISPSTHAQTIKEKISNGTSVSIHLRRGDYVKTSKANRYLRPLTMDYYQKAIDYINQRVKNPNFFLFSDDIKWAKSQVTFPPTTHFSTGTSAHEDLWLMTHCRHHIIANSTFSWWGAWLNQQPDKIVIAPQKWFSTERFDTKDLLPEPWIQL

SEQ ID NO: 32 - protein, 288 aa, Pseudoalteromonas haloplanktis
MIKVKAIGGLGNQLFQYATARAIAEKRGDGVVVDMSDFSSYKTHPFCLNKFRCKATYESKPKLINKLLSNEKIRNLLQKLGFIKKYYFETQLPFNEDVLLNNSINYLTGYFQSEKYFLSIRECLLDELTLIEDLNIAETAVSKAIKNAKNSISIHIRRGDYVSNEGANKTHGVCDSDYFKKALNYFSERKLLDEHTELFIFSDDIEWCRNNLSFDYKMNFVDGSSERPEVDMVLMSQCKHQVISNSTFSWWGAWLNKNDEKVVVAPKEWFKSTDLDSTDIVPNQWIKL

SEQ ID NO: 33 - protein, 277 aa, Unknown
  uncultured bacterium
MLTLKLKGGLGNQMFQYAASHNLAKNKKTKINFDLSFFSDIEVRDIKRDYLLDKFNISADISFDQKNSISGFRKFLVKVISKFFGEVFYYRLKFLSSKYLDGYFQSEKYFKNVEEDIRKDFTLKDEMGVEAKKIEQQIVNSKNSVSLHIRRGDYVDDLKTNIYHGVCNLDYYKRSIKYLKENFGEINIFVFSDDIAWVKENLAFENLQFVSRPDIKDYEELMLMSKCEHNIIANSSFSWWGAWLNENKNKIIIAPKEWFQKFNINEKHIVPKSWIRL

SEQ ID NO: 34 - protein, 289 aa, Clostridium sp. KLE 1755
MVIVQLSGGLGNQMFEYALYLSLKAKGKVVKIDDITCYEGPGTRPKQLDVFGVSYERATKQELTEMTDSSLDPVSRIRRKLTGRKTKAYREKDINFDPQVMERDPALLEGCFQSEKYFQDCREQVREAYRFRGIESGAYPLPEAYRRLEKEIADCKSVSVHIRRGDYLEESHGGLYTGICTEQYYQEAFARMEKEVPGAKFFLFSNDPDWTREHFKGENRILVEGSTEDTGYLDLYLMSKCKHNIIANSSFSWWGAWLNDNPEKKVTAPARWLNGRECRDIYTERMIRI

SEQ ID NO: 35 - protein, 281 aa, Francisella philomiragia
MKIIKIQGGLGNQMFQYAFYKSLKNNCIDCYVDIKNYDTYKLHYGFELNRIFKNIDLSFARKYHKKEVLGKLFSIIPSKFIVKFNKNYILQKNFAFDKAYFEIDNCYLDGYWQSEKYFKKITKDIYDAFTFEPLDSINFEFLKNIQDYNLVSIHVRRGDYVNHPLHGGICDLEYYNKAISFIRSKVANVHFLVFSNDILWCKDNLKLDRVTYIDHNRWMDSYKDMHLMSLCKHNIIANSSFSWWGAWLNQNDDKIVIAPSKWFNDDKINQKDICPNSWVRI

SEQ ID NO: 36 - protein, 288 aa, Pseudomonas fluorescens
MVIAHLIGGLGNQMFQYAAARALSSAKKEPLLLDTSSFESYTLHQGFELSKLFAGEMCIARDKDINHVLSWQAFPRIRNFLHRPKLAFLRKASLIIEPSFHYWNGIQKAPADCYLMGYWQSERYFQDAAEEIRKDFTFKLNMSPQNIATADQILNTNAISLHVRRGDYVNNSVYAACTVEYYQAAIQLLSKRVDAPTFFVFSDDIDWVKNNLNIGFPHCYVNHNKGSESYNDMRLMSMCQHNIIANSSFSWWGAWLNSNADKIVVAPKQWFINNTNVNDLFPPAWVTL

SEQ ID NO: 37 - protein, 293 aa, Herbaspirillum sp. YR522
MIATRLIGGLGNQMFQYAAGRALALRVGSPLLLDVSGFANYELRRYELDGFRIDATAASAQQLARLGVNATPGTSLLARVLRKVWPQPADRILREASFTYDARIEQASAPVYLDGYWQSERYFARIRQHLLDEFTLKGDWGSDNAAMAAQIATAGAGAVSLHVRRGDYVSNAHTAQYHGVCSLDYYRDAVAHIGGRVEAPHFFVFSDDHEWVRENLQIGHPATFVQINSADHGIYDMMLMKSCRHHIIANSSFSWWGAWLNPAEDKIVVAPQRWFKDATNDTRDLIPAAWVRL

SEQ ID NO: 38 - protein, 288 aa, Prevotella histicola
MKIVKILGGLGNQMFQYALYLSLKETFPQENVTVDLSCFHGYHLHNGFEIARIFSLHPDKATVMEILRIAYYYPNYFFWQIGKRVLPQRKTMCTESTKLLFDKSVLQREGDRYFDGYWQDERYFIDCRRTILNTFKFPPFTDDNNLALLKKMDTNSVSIHVRRGDYVGNKLYQGICDLNYYREAIMKISSYISPSMFCVFSNDIEWCRDNLESFIKAPIYYVDWNSGTESYRDMQLMSCCGHNIIANSSFSWWGAWLNQNSSKIVIAPKRWINLKNCGFMLPSRWVKI

SEQ ID NO: 39 - protein, 273 aa, Flavobacterium sp. WG21
MIVVQLIGGLGNQLFQYAAAKALALQTKQKFSLDVSQFESYKLHNYALNHFNVISKNYKKPNRYLRKIKSFYQKNVFYKEVDFGYNPDLIHLKGGIIFLEGYFQSEKYFIKYEKEIREDFELRTPLKKETKAAIAKIESVNSVSIHIRRGDYINNPLHNTSKEEYYNKALEIVENKINNPVYFVFSDDMEWVKANFSTKQETIFIDFNDASTNFEDLKLMTSCKHNIIANSSFSWWGGWLNKNPDKIVIAPKRWFNDDSINTNDIIPTNWVKI

SEQ ID NO: 40 - protein, 267 aa, Polaribacter franzmannii
MIIVRIVGGLGNQMFQYAYAKALQQKGYQVKIDITKFKKYNLHGGYQLDQFKIDLETSSPIANVLCRIGLRRSVKEKSLLFDEKFLEIPQREYIKGYFQTEKYFSSITPILRKQFIVQKELCNTTLRYLKEITIQKNACSLHIRRGDYISDEKANSVHGTCDLPYYKKSIKRIQDEYKDAHFFIFSDDISWAKKNLTNKNTTFIEHIVMPHEDMHLMSLCKHNITANSSFSWWGAWLNQHENKTVIAPKNWFVNRENEVACANWIQL

SEQ ID NO: 41 - protein, 267 aa, Polaribacter sp. MED152
MVVVRILGGLGNQMFQYAYAKSLAEKGYEVQIDISKFKSYKLHGGYHLDKFRIDLETANSSSAFLSKIGLKKTIKEPNLLFHKDLLKVNNNAFIKGYFQAEQYFSDIREILINQFKIKKELAKSTLAIKNQIELLKTTCSLHVRRGDYISDKKANKVHGTCDLDYYSSAIEHISKQNSNVHFFVFSDDIAWVKDNLNITNATYIDHNVIPHEDMYLMTLCNHNITANSSFSWWGAWLNQNPDKIVIAPKNWFVDKENEVACKSWITL

SEQ ID NO: 42 - protein, 285 aa, Methanococcus maripaludis
MKIIQLKGGLGNQMFQYALYKSLKKRGQEVLLDISWYLKNNAHNGYELEWVFGLSPEYASIRQCFKLGDIPINLIYNVKRKVFPKKTHFFEKSNFNYDNNVFEVTNGYFEGYWQNENYFKNFRSEILNDFSFKNIDKRNAEFSEYLKSINSVSVHVRRGDYVTNQKALNVHGNICNLEYYNKAINLANNNLKNPKFVIFSDDITWCKSNLGIDDPVYVDWNTGPYSYQDMYLMSNCKNNIIANSSFSWWGAWLNQNTEKKVFSPKKWVNDRNNVNIVPNGWIKIK

SEQ ID NO: 43 - protein, 292 aa, Gallionella sp. SCGC AAA018-N21
MIIAHIIGGLGNQMFQYAAGRALSLARGVPFKLDISGFEGYDLHQGFELQRVFNCAAGIASEAEVRDSLGWQFSSPIRRIVARPSLAVLRRSTFVVEPHFHYWAGIKQVPDNCYLAGYWQSEQYFQSHAAVIRTDFAFKPPLSGQNSKLAMQIAQGNAVSLHIRRGDYANNPKTTATHGLCSLDYYRAAIQHIAERVQSPHFFIFSDDIAWVKSNLAINFPHQYVDHNQGTESYNDMRLMSLCQHNIIANSSFSWWGAWLNTNAHKIVIAPKQWFANTTHVADLIPSSWERL

SEQ ID NO: 44 - protein, 311 aa, Azospira oryzae
MQSPACIAGARAWWVGYGMAEAMQPVVVGLSGGLGNQMFQYAAGRALAHRLGHPLSLDLSWFQGRGDRHFALAPFHIAASLERAWPRLPPAMQAQLSRLSRRWAPRIMGAPVFREPHFHYVPAFAALAAPVFLEGYWQSERYFRELREPLLQDFSLRQPLPASCQPILAAIGNSDAICVHVRRGDYLSNPVAAKVHGVCPVDYYQQGVAELSASLARPHCFVFSDDPEWVRGSLAFPCPMTVVDVNGPAEAHFDLALMAACQHFVIANSSLSWWGAWLGQAAGKRVIAPSRWFLTSDKDARDLLPPSWERR

SEQ ID NO: 45 - protein, 290 aa, Prevotella paludivivens
MKIVKIIGGLGNQMFQYALAMALNKNFTDEEVKLDIHCFNGYTKHQGFEIDRVFGNEFELASYRDVAKVAYPYFNFQLWRIGSRIFPDRRHMISEDTSFKIMPEVITSHNYKYYDGYWQHEEYFKNIHDEILDAFKFPKFQDERNKALAERLSDSNSISIHIRRGDYLNDELFKGTCGIEYYKKAIEEINERTVPTLFCVFSNDIHWCKENIEPLLNGKETIYVDWNTGSDNYRDMQLMTKCKHNIIANSSFSWWGAWLNNTKDKIVIAPRIWYNTKEKVSPVANSWIKL

SEQ ID NO: 46 - protein, 300 aa, Gramella forsetii
MSNKNPVIVEIMGGLGNQMFQFAVAKLLAEKNSSVLLVDTNFYKEISQNLKDFPRYFSLGIFDISYKMGTENGMVNFKNLSFKNRVSRKLGLNYPKIFKEKSYRFDADLFNKKTPIYLKGYFQSYKYFIGVESKIRQWFEFPYENLGVGNEEIKSKILEKTSVSVHIRRGDYVENKKTKEFHGNCSLEYYKNAITYFLDIVKEFNIVFFSDDISWVRDEFKDLPNEKVFVTGNLHENSWKDMYLMSLCDHNIIANSSFSWWAAWLNNNSEKNVIAPKKWFADIDQEQKSLDLLPPSWIRM

SEQ ID NO: 47 - protein, 298 aa, Mariprofundus ferrooxydans
MIIVQFTGGLGNQMFQYALGRRLSLLHDVELKFDLSFYQHDILRDFMLDRFQVNGQVATEKEIEAYTNTPIFALDRPLLDRLVRWGLYRGIVSVSDEPPGKQALMVYNSRVLQAPRNTYVQGYWQSEKYFMPIRQKLLDDFSLVDKADQANGAMLEKIRQCHSVSLHVRRGDYVSNPLTNHSHGTCGLEYYEKAIALIGSKVDDPHFFVFSDDPEWTRDHLKCRFPMTYVTCNSADSCEWDMELMRHCRDHIIANSSFSWWGAWLNMNPDKVVVAPAAWFNNFSADTSDLIPDSWVRI

SEQ ID NO: 48 - protein, 291 aa, Bacillus cereus
MKIIQVSSGLGNQMFQYALYKKISLNDNDVFLDSSTSYMMYKNQHNGYELERIFHIKPRHAGKEIIDNLSDLDSELISRIRRKLFGAKKSMYVELKEFEYDPIIFEKKETYFKGYWQNYNYFKDIEQELRKDFVFTEKLDKRNEKLANEIRNKNSVSIHIRRGDYYLNKVYEEKFGNIANLEYYLKAINLVKKKIEDPKFYIFSDDIDWAQKNINLTNDVVYISHNQGNESYKDMQLMSLCKHNIIANSTFSWWGAFLNNNDDKIVVAPKKWINIKGLEKVELFPENWITY

SEQ ID NO: 49 - protein, 300 aa, Firmicutes bacterium CAG:534
MIIIRMTGGLGNQMFQYALYLKLRAMGKEVKMDDFTEYEGREARPLSLWAFGIEYDRASREELCRMTDGFLDPVSRIRRKLFGRKSLEYMEKDCNFDPEILNRDPAYLTGYFQSEKYFADIEEEVRQAFRFSERIWEGIPSQLLERIRSYEQQIKTTMAVSVHIRRGDYLQNEEAYGGICTERYYKTAIEYVKKRQQDASFFVFTNDPDYAGEWILKNFGQEKERFVLIEGTQEENGYLDLYLMSLCRHHILANSSFSWWGAYLNPSREKMVIVPHKWFGNQECRDIYMENMIRIAKEQS

SEQ ID NO: 50 - protein, 292 aa, Sideroxydans lithotrophicus
MVISNIIGGLGNQMFQYAAARALSLKLEVPLKLDISGFTNYALHQGFELDRIFGCKIEIASEADVHEILGWQSASGIRRVVSRPGMSIFRRKGFVVEPHFSYWNGIRKITGDCYLAGYWQSEKYFLDAAVEIRKDFSFKLPLDSHNAELAEKIDQENAVSLHIRRGDYANNPLTAATHGLCSLDYYRKSIKHIAGQVRNPYFFVFSDDIAWVKDNLEIEFPSQYVDYNHGSMSFNDMRLMSLCKHHIIANSSFSWWGAWLNPNPEKVVIAPERWFANRTDVQDLLPPGWVKL

SEQ ID NO: 51 - protein, 292 aa, zeta proteobacterium SCGC AB-137-C09
MIVSQIIGGLGNQMFQYATGRALSHRLHDTFFLDLDGFSGYQLHQGFELSNVFQCEVNVATRSQMQALLGWRSFSSVRRLLMKRSLKWARGHRVMIEPHFHYWSRFAEINEGCYLSGYWQSERYFKPIENIIRQDFKFNHLLKGVNLDLAQQMTEVNSVSLHVRRGDYASDANTNHTHGLCPLDYYRDAILYIAQNTVAPSFFIFSDDIEWCREHLKLSFPATYIDHNKGSNSYCDMQLMSLCHHHIIANSSFSWWGAWLNTRLDKIVIAPKQWFANGNRTDDLIPAEWLVM

SEQ ID NO: 52 - protein, 283 aa, Pedobacter heparinus
MKIIRFLGGLGNQMFQYAFYKSLQHRFPHVKADLQGYQEYTLHNGFELEHIFNIKVNSVSSFTSDLFYNKKWLYRKLRRILNLRNTYIEEKKLFSFDPSLLNNPKSAYYWGYWQNFQYFEHIADDLRKDFQFRAPLSAQNQEVLDQTKLSNSISLHIRRGDYIKDPLLGGLCGPEYYQTAINYITSKVNAARFFIFSDDIDWCIANLKLQDCSFISWNKGTSSYIDMQLMSSCKHHIVANSSFSWWAAWLNPNPDKIVIAPEKWTNDKDINVRMSFPQGWISL

SEQ ID NO: 53 - protein, 278 aa, Methylophilus methylotrophus
MFQYAMGLSLAENNQTPLKLDLSQFTDYKLHNGFELSKVFNCSAETASVTQIETLLGICKYSFIRRILKNTYLKNLRPAQYVVEPFFGYWDGVNFLGDNVYLEGYWQSQKYFIDYESTIRTHFTFKNILSGENLKLSDRIKGSNSVSLHIRRGDYVTNKNNAFIGTCSLIYYQNAIEYFSTKIADPIFFIFSDDITWAKSNLRLANEHYFVGHNQGEDSHFDMQLMSLCKHHIIANSSFSWWGAWLNPSKDKIIIAPKKWFASGLNDQDLVPKDWLRI

SEQ ID NO: 54 - protein, 285 aa, Rhodobacterales bacterium HTCC2255
MIYTRIRGGLGNQLFQYSAARSLADYLNVSLGLDTREFDENSPYKMSLNHFNIRADLNPPDLIKHKKDGKIAYIIDHIKGNQKKVYKEPFLSFDKNLFSNVDGTYLKGYWQSEKYFLRNRKNILSDINLIKKTDKFNTINLKEIKKSTSISLHIRRGDYLSNESYNETHGICSLSYYTDAVEYIKNRLGENIKVFAFSDDPDWVLENLKLSVDIKIINNNTSANSFEDLRLMLNCDHNIIANSSFSWWGAWLNQNPEKIVISPKKWYNKKQLQNADIVPSSWLKY

SEQ ID NO: 55 - protein, 295 aa, Spirulina subsalsa
MAKIIARIRGGIGNQIFIYAAARRLELINNAELVLDSVSGFVHDLQYRQHYQLDHFHIPCRKATPAERFEPFSRVRRYLKRQLNQRLPFEQRRYVIQESIDFDPRLIEFKPRGTVHLEGYWQSEDYFKDIEATIRQDLQIQPPTDPTNLAIVQHIHQHTSVAVHIRFFDQPNADTMNNAPSDYYHRAVEAMETFVPGAHYYLFSDQPEAAKSRIPLPDERVTLVNHNRGNKLAYADLWLMTQCQHFIIANSTFSWWGAWLAENQKKQVIAPGFEKREGVSWWGFKGLLPKQWIKL

SEQ ID NO: 56 - protein, 287 aa, Vibrio cyclitrophicus
MVIVKITGGLGNQLFQYATGSALANKLSCELVLDLSFYPTQTLRKYELAKFNINARVATDREIFLAGGGNDFFSKALKKLGLTSIIFPEYIKEQESIKYVGKIDLCKSGAYLDGYWQNPLYFSQNKIELTREFLPRAQLSPSALAWKDHISQASNSVSLHVRRGDYVENAHTNNIHGTCSLEYYQHAIEKIRSEVHNPVFFVFSDDIEWCKLNLSSLAEVEFVDNTTSAIDDLMLMRQCKHSIIANSTFSWWGAWLKLDGLVIAPRNWFSSASRNLKGIYPKEWHIL

SEQ ID NO: 57 - protein, 288 aa, Lachnospiraceae bacterium NK4A179
MRSVVDIKGGYGNQLFCYSFGYAVSKETGSELIIDTSMLDMNNVKDRNYQLGVLGITYDSHISYKYGKDFLSRKTGLNRLRKKSAIGFGTVVFKEKEQYVYDPSVFEIKRDTYFDGFWQSSRYFEKYSDDLRKMLKPKKISNAAEKLAEDARDCLSVSVHIRRGDYVSLGWTLKDDYYIKALDIIKERYGSEPVFFVFSDNKKYADDFFSAAGLKYRLMDYETDDAVRDDMFLMSRCSHNIMANSSYSWWGAFLNDNKDKTVICPETGVWGGDFYPEGWMKVTASSGK

SEQ ID NO: 58 - protein, 291 aa, Unknown
  uncultured bacterium
MIIVNLYGGLGNQMFQYALGRHLAEKNNTELKLDISAFESYKLRKYELGNLNIIEKFALPEEISRLSTLPTGKIERFIRKTLRKPVKKPESYIKENITGGFNPKILDLQNNIYLEGYWQSEKYFIEIEDIIRKEFSFKFPATGKNKEILENILNINSVSLHIRRGDYVTNPEVNQVHGVCSLDYYKSCVDFIEKKLESPYFYIFSDDIEWVKNNLQIQSQVYYVDHNTVDNAIEDMRLMFSCKHNILANSSFSWWGAWLNSNPDKMVITPRKWFNTTYDSNDLIPERWIKL

SEQ ID NO: 59 - protein, 760 aa, Bacteroides fragilis
MKIGIIYIVTGPYIKFWNEFYSSSQLYFCVEAEKNYEVFTDSSELASQRLPNVHMHLIEDKGWIVNVSSKSKFICEIRNQLTSYDYIFYLNGNFKFISPIYCDEILPQAEHNYLTALSFSHYLTIHPDHYPYDRNKNCNAFIPYGQGKYYFQGGFYGGRTQEVLSLSEWCRDAIEADFNKKVIARFHDESYINRYLLTQHPKVLNDKYAFQDIWPYEGEYKAIVLNKEEVPEDNNLQEMKQNYIDPSLSFLLNDELKFIPISIVQLYGGLGNQMFGYAFYLYIRHISTQERKLLIDPAPCKRYGNHNGYELPSIFSKICQDIHISDETKNNIRKLRKGTSLSIEEVRASMPQSFKEKKQPIIFYSGCWQCVTYVETVKDEIKKDFIFDESKLNEPSAQMLRIIRRSNSVSVHIRRNDYLIGNNEFLYGGICTKSYYEKAISQMYTLLKDEPIFIYFTDDPEWVRSNFALDKSYLVDWNKNKDNWQDMYLMSACRHHIIANSSFSWWAAWLGGFPEKKVIAPSTWLNGMQTPDILPTEWIKIPITPDKKILDRICNHLILHSSYMKQLGLNSGKMGVVIFFFHYARYTQNPLYENYAGDLFDELYEEIHKGISFSFLDGLCGIAWAVEYLVHEQFIEGNTDDSLAEIDFKVMQIDPRRFTDYSFETGLEGIACYVLSRLLSPRVCSSSLTLDSVYLKDLTEACRKVPVDKANYTRLFLNYIESKEVGYSFKDVLMQVLNHSEKAFGSDGLTWQTGLTMIMR

SEQ ID NO: 60 - protein, 290 aa, Butyrivibrio sp. AE3009
MIIIQLKGGLGNQMFQYALYKELRSRGKEVKIDDVTGFVDDELRTPVLQRFGIEYDRATREEVVKLTDSKMDIFSRIRRKLTGRKTCRIDEESGTFNPDILELDEAYLVGYWQSDKYFRNEDVIAQLRQEFQKRPQEIMTDSASWATLQQIECCQSVSLHIRRTDYIDEEHNHIHNLCTEKYYKGAIDRIRSQYPSAVFFIFTDDKEWCRNHFRGPNFFVVELAEKENTDIAEMLLMSSCKHHICANSSFSWWSAWLNDSPEKMVIVPNKWINNRDMDDIYTDRMTKMAI

SEQ ID NO: 61 - protein, 277 aa, Bacteroides ovatus
MKQTIILSGGLGNQMFQYAFFLSMKAKGKSCSLDTTLFQTNKMHNGFELKSVFDIPDSPNQASALHSLLIKMLRRYKPKSILTIDEPYTFCPDALESKKSFLMGDWLSPKYFESIKDVVVNAYRFHNIGNKNVDTANEMHGNNSVSIHIRRGDYLKLPYYCVCNENYYRQAIEQIKDRVDNPIFYVFSNEPSWCDSFMKEFRVNFKIVNWNQGKDSYQDMYLMTQCKHNIIANSTFSWWGAWLNNNTDKIIVAPSKWFKNSEHNINCKEWLLIDTSK

SEQ ID NO: 62 - protein, 291 aa, Desulfospira joergensenii
MGKKYVETVVNGGLGNQIFQFSAGFALSKRLNLDLVLNISTFDSCQKRNFELYTFPKIKNSFACIKDDDPGVFSRLRIPFLNFKEKIKQFHESHFFFDPAFFDIREPVRIEGYFQSYKYFEKYSDQLKDILLDIPLTSRLKTVLKVISSKKESVSVHIRRGDYISDQGINEVHGTLNEAYYLNSIKLMEKMFPESFFFLFTDDPHYVEENFKFLEDTSCIISDNDCLPYEDMYLMANCHHNIIANSSFSWWGAWLNQNPEKIVIAPRKWFSRKILMEKPVMDLLPDDWILL

SEQ ID NO: 63 - protein, 303 aa, Lachnospiraceae bacterium 10-1
MNIIRMTGGLGNQMFQYALFLRLKAQGKEVKFDDRTEYKGEEARPILLWAFGIDYPAAGEEEVNELTDGVMKFSHRLRRKLFGRKSKEYREKSCNFDQQILEKEPAYFTGYFQSERYFEEVKEQVRKAFQFSGKIWGSVSKELEERIREYQTKIENKSQMPVSVHIRRGDYLENDEAYGGICTDAYYRKAIEMMEEKFPNTVFYIFSNDTGWAKQWIDHFYKEKSRFIVIEGTTEDTGYLDLFLMSKCRAHIIANSSFSWWGAWLDPDQEKIVIAPSKWVNNQDMKDIYTREMIKISPKGEVR

SEQ ID NO: 64 - protein, 289 aa, Bacteroides dorei
MVVVYVGAGLANRMFQYAFALSLREKGLDVFIDEDSFIPRFDFERTKLDSVFVNVNIQRCDKNSFPLVLREDRFYKLLKRISEYMSDNRYIERWNLDYLPYIHKKASTNCIFIGFWISYKYFQSSEDAVRKAFTFKPLDSIRNVELATKLVTENSVAVHFRKNIDYLKNLPNTCPPSYYYEAINYIKKYVPNPKFYFFSDNWDWVRENIRGVEFTAVDWNPSSGIHSHCDMQLMSLCKHNIIANSTYSWWSAYLNENNNKIVVCPKDWYGGMVKKLDTIIPESWIIING

SEQ ID NO: 65 - protein, 292 aa, Firmicutes bacterium CAG:24
MVIVKMSGGLGNQMFQYALYRKIQQTGKDVKLDLFSFQDKNAFRRFSLDIFPIEYQTANLEECRKLGECSYRPVDKIRRKMFGLKESYYQEDLDKGYQPEILEMNPVYLDGYWQCERYFQDIREKILEDYTFPKKISIESSRLQERIKNTESVSIHIRRGDYLDAANYKIYGNICTIEYYQSAISRMRKLCEKPNFYLFSNDPEWAKEIFGDTEDITIVEEDKERPDYEDMFLMSRCKHNIIANSSFSWWAAWLNQNENKRVIAPVKWFNNHSVTDVICDDWIRIDGDHKGA

SEQ ID NO: 66 - protein, 294 aa, Clostridium hathewayi CAG:224
MIYVNIRGRLGNQLFIYAFARALQKSTNQQITLNYTSFRKHYNNTAMDLEQFNIPEDIMFENSKELPWFANTDGKVIRILRHYFPKLIRSILQKMNVLMWLGDEYVEVKVNKRRDIYIDGFWQSSRYFKSVYKELKNELIPKMEMSKEIKTMGDLINQKESVCVSVRRGDYVTVKKNRDVYYICDEKYLNTSIMRMVELVPNVTWFIFSDDADWVKDNIVFPGEVFYQPPRVTPLETLYLMKACKHFIISNSSFSWWGQYLSNNDNKIVIGPAKWYVDGRKTDIIEEEWIKIEV

SEQ ID NO: 67 - protein, 294 aa, Syntrophus acidotrophicus
MVIVRLTGGIGNQMFQYAAARRVSLVNNAPLFLDLGWFQETGSWTPRKYELDAFRIAGESASVGDIKDFKSRRQNAFFRRLPLFLKKRIFHTRQTHIIEKSYNFDPEILNLQGNVYLDGYWQSEKYFSDVDSEIRREFSFQTDPAERNRKILERIASCESVSIHIRRGDYVTLPDANAFHGLCTPAYYRLAVEQISRKVVEPVFFVFSDDIAWARGNLKLGFETCFMDQNGPDRGDEDLRLMIACRHHIIANSSFSWWGAWLCSNPEKIVYAPRKWFNNGLDTPDNIPASWIRI

SEQ ID NO: 68 - protein, 290 aa, Bacteroides caccae
MKIVKIIGGLGNQMFQYALYLSLKKKYPKEKIKIDISMFETYGLHNGFELKRIFDIDAEYASREEIRELSFYIKIYKLQRIFRKIFPVRKTECVEKYDFKFMSEVWSNCDRYYEGYWQNWEYFIEAQTEVRSTFTFKKELVGRNAKVIREIQYAKMPVSLHIRRGDYLHHKLFGGLCDLNYYKKAIDYVLNNYDTPQFYLFSNDIEWCKTYILPLVQGYPFILVDWNSGVESYIDMQLMSCCRINIIANSSFSWWAAWLNDSSEKIVIAPKLWAHSPYGKEIQLKSWLLF

SEQ ID NO: 69 - protein, 291 aa, Butyrivibrio fibrisolvens
MIIIEMSGGLGNQMFQYALYKSMLHKGLDVTIDKSIYRDVDHKEQVDLDRFPNVSYIEADRKLSSTLRGYGYNDSIIDKIRNKLNKSKRNLYHEDLDKGYQPEIFEFDNVYLNGYWQCERYFKDIKNEIKKDFIFPCTQSGDDKIKALTIEMESCNSVSLHVRRGDYLKPGLIEIYGNICTEEYYKKSIEYIKERVDNPVFYIFSNDMAWVRDNFKSDDFRYVNEDGAFDGMTDMYLMTRCRHNIVANSSFSWWGAWLNKHDDNIVICPNRWVNTHTVTDIICEDWIRIDV

SEQ ID NO: 70 - protein, 309 aa, Parabacteroides distasonis
MIVGGNDYCKVKVVNIIGGLGNQMFQYAFALSLKEHFPKEEIRIDISHFNYLFVNKVGAANLHNGYELDKIFFNIELKKANAWQLMKLTWFIPNYLISRIARKILPVRNSEYIQNSSDCFFYDPMVYNKQGSCYYEGYWQAIGYYESMRDKLCKIFQHPSPEGKNKQYIENMESSNSVGIHIRRGDYLLSDNFRGICEVDYYKRAIDKILQDGEKHVFYLFSNDQKWCEEYILPLLGNYEIIFVTGNIGRDSCWDMFLMTHCKDLIIANSSFSWWGAFLNKRGGRVVTPKRWMNRNIRYDLWMPEWIRI

SEQ ID NO: 71 - protein, 295 aa, Geobacter uraniireducens
MIIARLQGGLGNQMFQYAVGLHLALTHNVELKIDITMFSDYKWHTYSLRPFNIRESIATEEEIKALTDVKMDRPYKKIDNFLCRLLRKSQKISATHVKEKHFHYDPDILKLPDNVYLDGYWQSEKYFKEIENIIRQTFIIKNPQLGRDKELACKILSTESVCLHIRRGNYVTDKTTNSVLGPCDLSYYSNCIKSLAGNNKDPHFFVFSNDHEWVSKNLKLDYPTIYVDHNNEDKDYEDLRLMSQCKHHIIANSTFSWWSAWLCSNPDKVIYAPQKWFRVDEYNTKDLLPSNWLIL

SEQ ID NO: 72 - protein, 293 aa, Lachnospiraceae bacterium A4
MIIVKIYEGLGNQLFQYAFARSIQVNGKKVFLDTSGYTDQLFPLCRTSTRRRYQLNCFNIRIKEVEKKNIEKYSFLIQEDMFGKLISKLAKLHLWMYKVTIQQNAQEYKESYLNTRGNVYYKGWFQNPKYFSSIRRLLLKEITPKYKIRIPAELRELLQEDNIVAVHCRRGDYQYIRNCLPVNYYKKAMAYMEKKLGVPRYLFFSDDLSWVKRQFGNKDNNYYIEDYGKFEDYQELMIMSRCRNFIIANSTFSWWAAWLCSYENKVVIMPRVWTYVGGQGVEMSDFPADWIRI

SEQ ID NO: 73 - protein, 294 aa, Colwellia psychroerythrus
MKVVRVCGGFGNQLFQYAFYLAVKHKFNETTKLDIHDMASYELHNGYELERIFNLNENYCSAEEKLAVQSTKNIFTKLLKEIKKYTPFIPRTYIKEKKHLHFSYQEVDLGTKDTSIYYRGSWQNPQYFNSIASEIREKLTFPEFTEPKSLALHQEISEHETVAVHIRRGDYLKHKALGGICDLPYYQNAIKEIEGLVEKPLFVIFSDDITWCRANINVEKVRFVDWNSGEQSFQDMHLMSLCTHNIIANSSFSWWGAWLNANPNKIVISPNKWIHYTDSMGIVPSEWIKVETSI

SEQ ID NO: 74 - protein, 282 aa, Roseobacter sp. MED193
MITSRLHGRLGNQMFQYAAARALAHRLGCGVALDGRGAELRGEGVLTRVFDLPLSAAPKLPPLKQHAPLRYGLWRGLGLAPRFRRERGLGYNTAFETWEDGCYLHGYWQSERYFEEISDLIRADFTFPDFSNRQNAEMAARIMEDNAISLHVRRGDYVALSAHVLCDQAYYEAALTRLLEGLSQDAPTVYVFSDDPDWAKANLPLPCKKVVVDFNGPETDFEDMRLMSLCKHNIIGNSSFSWWAAWLNANPQKRVAGPANWFGDPKLSNPDILPSQWLKVAP

SEQ ID NO: 75 - protein, 296 aa, Cesiribacter andamanensis
MMIVRLCGGLGNQLFQYAVGKQLSVKNNIPLKIDDSWLRLPDARKYRLQFFQIEEPLASPQEVERFVGPYESQSLYARLYRKVQNMLPRHRRRYFQESGFWAYEPELMRIRSQVFLEGFWQHHAYFTRLHPQVLEALQLREEYRQEPYAVLDQIREDAASVSLHIRRGDYVSDPYNLQFFGVMPLSYYQQAVAYMQEQLHAPTFYIFSDDLDWARAHLKLQAPMVFVDIEGGRKEYLELEAMRLCRHNILANSSFSWWGAYLNTNPHKRVIAPRQWVADPELKDKVQIQMPDWILL

SEQ ID NO: 76 - protein, 309 aa, Rhodopirellula sallentina
MIATRLIGGLGNQMFQYAYGFSLARRRSERLVLDVSAFESYDLHALAIDQFDISAARMTQAEFARIPGRYRGKSRWAERVANFAGGLQSCDKRPLRLRREKPFGFAEKYLAEGSDLYLDGYWQSERYFPGLQAELKKEFQLKRGLSDESSRVLDEIQSSMSVAMHVRRGDYVTNAETLRIYRRLDAEYYRKCLNDLRQRFSNLNVFVFSNDIQWCQDHLDVGLKQRPVTHNDATTAIEDMFLMSQCDHSIIANSSFSWWAAFLGRSDAQRRVYYPDPWFNPGTLNGDSLGCANWVSESSISVSRPSRAA

SEQ ID NO: 77 - protein, 289 aa, Butyrivibrio sp. AD3002
MIIIRMMGGLGNQMFQYALYLQLKALGKEVKIDDVYGFRDDPQRDPVLEKMYGITYTKASDAEVVDITDSHLDIFSRIRRKLFGRKSHEYIEETGLFDPKVFEFETAYLNGYFQSDKYFPDKEVLAQLRREFVIKPDDVFTSADSWELYRQIRETESVSIHVRRGDYLLPGTVETFGGICDNDYYKRAIDRMVSEHPDAIFFVFTSDKEWCEQNVSGKKFRIVDTKEENDDAADLLLMSLCKHHILANSSYSWWSAWMNDSPEKTVIVPSKWLNTKPMDDIYTSRMTKI

SEQ ID NO: 78 - protein, 279 aa, Segetibacter koreensis
MVVVKLIGGMGNQMFQYAIGRHLAIKNKCPLYFDHIELENKNTANTPRNYELDIFNVQYQKNPFLQSNRFVAKVYHKLFSVQRIKEPDFTFHPHILNVQGNIHLNGYWQNENYFKEIEEIIRQDFTFKTPANEKIESILQQIAATNSVSLHVRRGDYITLTEANQFHGVCSDTYYQKAIAKIKEAIPAPHLFVFSDDIHWVKQNMPFTEEHTFVDGNTGKNSFEDLRLMAACRHNILANSSFSWWAGWLNKNPEKMVIAPEKWFRAVHTDIVPPSWIKM

SEQ ID NO: 79 - protein, 288 aa, Amphritea japonica
MVIVRLIGGLGNQLFQYAYALSLLEQGYDVKLDASAFESYTLHGGFGLGEYAERLEVATTEEVDMVSRVGRISTLLRKLQGKKSRRVIKESNFSYDEKMLTPEDSHYLVGYFQSELYFNKIRGELLSALDLKHKLSPYTEASYLAIADASVSVSMHIRRGDYVSDKAAHNTHGVCSLDYYYAAVTFFEERYPDVDFYIFSDDIEWVKENLNVQRAHYISSEEKRFAGEDIYLMSQCDHNIVANSSFSWWGAWLNANEDKIVVAPRQWYADSNMQRLSKTLVPDTWIRL

SEQ ID NO: 80 - protein, 280 aa, Desulfovibrio vulgaris
MRPVVVDIFGGLGNQMFQYAAAKSLAERLGVRLELDVSMFSGDPLRAFSLGEFAITDHVRGKSRSSLLVRFARSLGFGSSSKCVEPFFHYWEGINEIEAPVHMHGYWQSEKYFKAYEDLIRRTFSFSACEGVASSGKYAGVSSPMSVSVHLRRGDYKEQKNVVVHGILGREYYDAAYSIIKQGCPSACFFVFTDAINEAVDFFSHWNDVLFVDGNNQYQDMYLMSQCRHHIIANSSYSWWGAWLGAFSDGMTVAPKMWFAYDVLKEKSIKDLFPEDWIVL

SEQ ID NO: 81 - protein, 290 aa, Spirosoma spitsbergense
MIISRITSGLGNQLFQYAVARHLSLKNKTSLYVDLSYYLYQYHDDTSRNFKLGNFSVPYHTLQQSPVEYVSKATKLLPNRSLRPFFLFQKERQFHFDEQILQSRAGCVILEGFWQSEAYFRDNADTIRRDLQLSGTPSPEFNQYRELIRETPMSVSIHVRRSDYVNHPEFSQTFGFVGIDYYKRAIELARKELANPRFFVFSDDKEWSKTNLPLGEDSVFVQNTGLNGDVADLVLMSHCQHHIIANSSFSWWGAWLNPNAGKLVITPKNWYKNKPAWNTKDLLPPTWLSI

SEQ ID NO: 82 - protein, 306 aa, Lachnospiraceae bacterium 28-4
MNIIRMSGGIGNQMFQYALYLKLVSLGKEVKFDDVTEYELDNARPIMLSVFGIDYPKASREELVELTDASMDFLSRVRRKIFGRKSGEYHEASADYDETVLEKEHAYLCGCFQSERYFKDIEYEVREAYRFRNVVVPEEIRGGIETYERQIGESLSVSIHIRRGDYLDAADVYGGICTDAYYNQAIRYMIKKYENPSFFVFTNDTFWAEKWCEVRERETGKRFTVIKGTDEETGYIDLMLMSRCKAHIIANSSFSWWGAWLDASPDKCVVAPVKWINTRECRDIYTEDMVRIGSNGKISFSNCSSL

SEQ ID NO: 83 - protein, 281 aa, Lachnospiraceae bacterium COE1
MVVVRIWEGLGNQLFQYAYARALSLRTKDRVYLDISEYEMSPKPVRKYELCHFKIKQPVINCGRIFPFVNKDSFYTKNNQYLRYFPAGLIKEEDCYFKRDFCELKGLLYLKGWFQSEKYFKEFESHIREEIYPRNKIKITRGLRKILNSDNTVSVHIRRGDFGKDHNILPIEYYENSKRVILERVDNPYFIIFSDDILWVKENMNFGLNCFYMDKEYSYKDYEELMIMSRCKHNIIANSTFSWWGAWLNPSKDKIVIAPKKWFLYNPKKDFDIVPNDWIRV

SEQ ID NO: 84 - protein, 301 aa, Parabacteroides distasonis CL09T03C24
MKIVNIIGGLGNQMFQYAFAVALKAKYPNEEVFIDTQHYKNAFIKVYHGNNFYHNGYEIDKVFPNATLEPARPKDLMKVSFYIPNQVLARAVRRIFPKRKTEFVTDQQPYVFIPEALSVIDDCYFDGYWMTPLYFDKYRDRILKEFTFRPFDTKENLELEPLLKQDNSVTVHIRRGDYVGSSSFGGICTLDYYRNAIREAYNLITSPEFFIFSNDQKWCMENMRNEFGDAKVHFIAHNRGADSYRDMQLLSIARCNILANSSFSWWGAYLNQRKNCFIICPHKWHNTLEYSDLYLPTWIKI

SEQ ID NO: 85 - protein, 283 aa, Bacteroides sp. HPS0048
MFVIRLIGGVGNQLFQYTFGQFLRHKFGVEVCYDIVAFDTVDKGRNLELQLLDESLPLFETSNFFFSKYKSWKKRLFLYGFLLKKNNKYYTKYAPEEISLFTEKGLSYFDGWWQYPALLRDTINNMEDFFIPKQPIPVQIQKYYNEILLNNFAVALHVRRGDYFTSKYAKTYAVCNVEYYTSAVNLMCEKLRSCKFYVFSDDLDWVKSNLILPSNTVYVKNYDINSYWYIYLMSLCRHIIISNSSFSWWGATLNRNFHKIVIAPKYWSTKKNNTLCDNSWIKI

SEQ ID NO: 86 - protein, 291 aa, Bacteroides thetaiotaomicron
MKIINILGGLGNQMFEYAMYLALKNAHSEEEILCSTRSFCGYGLHNGYELGRIFGIQVKEASLLQLTKLAYPFFNYKSWQVMRHWLPVRKTMTRGAINIPFDYSQVMREDSVYYDGYWQNEKNFLHIREEILTAYTFPKFDDEKNQELADIIVKSNAVSCHIRRGDYLKEINMCVCTSSYYAHAISYMNEEINPNLYCVFSDDIEWCRNNICELMGEDKKIIFIDWNKGEKSFRDMQLMSLCKHNIIANSSFSWWGAWLNRNDKKIVVAPTRWIASEVKNDPLCDSWKRIE

SEQ ID NO: 87 - protein, 292 aa, Desulfovibrio alaskensis
MKFVGVWILGGLGNQMFQFAAAYALAKRMGGELRLDLSGFKKYPLRSYSLDLFTVDTPLWHGLPMSQRRFRIPMDAWTRGSRLPLVPSPPFVMAKEKNFAFSPIVYELQQSCYLYGYWQSYRYFQDVEDDIRTLFSLSRFATLELAPVVAQLNEVESVAVHLRRGDYITDAASNAVHGVCGIDYYQRSMSLVRRSTTKPIFYIFSDEPEVAKKLFATEDDVVVMPSRRQEEDLLLMSRCKHHIIANSSFSWWAAWLGKRASGLCIAPRYWFARPKLESTYLFDLIPDEWLLL

SEQ ID NO: 88 - protein, 296 aa, Prevotella oralis CC98A
MDIVVIFNGLGNQMSQYAFYLAKRKSGSRCHCIFHNVSTGFHNGSELDKVFGIKYEKGIFSKLLSKIYDIFDGIPKLRKKLNSLGIHIIREPRNYDYTASLLPRVSRWGLNYFVGGWHSEKYYTEILQEIKNTFSFKIDDEIKDIDFYEFYSLIHNDINSVSLHIRRGDYVGANEYSYFQFGGVATLEYYHKAIDEIYQRIENPTFYVFSDDIGWCKTTFLKNNFIFVDCNCGEKSWRDMFLISQCKHHIIANSTFSWWGAWLSIFHNSITICPKEFIKGVVIRDVYPDTWIKLSS

SEQ ID NO: 89 - protein, 303 aa, Comamonadaceae bacterium CR
MASKISKIIPRIFGGLGNQLFIYAAARRLALVNGAELALDDVSGFVRDHEYNRHYQLDHFNIPCRKATAAERLEPFARVRRYLKRKWNQRLPFEQRKYLVQESVDFDERLLTFKPRGTVYLEGYWQSEDYFKDIEPQIRADLRIHPPTDTVNQQMAERIRATNAVAVHVRFFDAPAQSALGVGGNNAPGDYYQRAIKVMQEQAPDAQYYIFSDQPQAARARIPLRDDHVTLVNHNQCDAVAYADLWLISQCQHFIIANSTFSWWGAWLGKTPESIVIAPGFEKREGAMFWGFRGLLPDRWVKL

SEQ ID NO: 90 - protein, 292 aa, Vibrio nigripulchritudo
MKDSRIVKLNGGLGNQMFQFALAFALKKKLNVAVKFDTELLDTNRTEFKLSLERFGLIVDKLTITEKFKYKGLESCKYRKICNWISNFTTINIHKGYYKEKERGVYDRGIFDSNVKYIDGYWQNQEYFNDFRSELLNKFNLNGKVSNHAIQYLKEITSVQNSVSIHVRRGDYLLLDVYRNLTLDYYSEAIKLVRITNPDSKFFIFSNDINWCKSNFKSVDNAIFVDSTVDEFDDMFLMSKCKTNIIANSTFSWWAAWLNNNSGKIVYCPKKWRNDTTEVHKGLPEGWNIIDK

SEQ ID NO: 91 - protein, 295 aa, Sulfurospirillum deleyianum
MIIIKIMGGLTSQMHKYALGRVLSLKYNVPLKLDLTWFDNPKSDTPWEYQLDYFNINATIATVSEIKKLKGNNLFNRIARKIEKFFSIRIYKKSYINKSFISISDFHKLKSDIYLDGEWNGFKYFEDYQDTIKNELTLKRGSSINIQNTIKELKSSDNSVFLHIRRGDYLSNKNAAAFHAKCSLDYYYKAIQIVKEKIDNPIFYIFSDDILWVKKNFVINESCRFMEKNQNFEDLLLMSYCKHGITANSGFSLMAGWLNQNKDKMIIVPQTWVNDDRININILNSLEQDNFTIIR

SEQ ID NO: 92 - protein, 298 aa, Escherichia coli
MTFIVRLTGGLGNQMFQYALARSLAKKYNARLKLDISYYHNQPHKDTPRTFELNQLCIVDNILNSSSFSEKFLYIYDKLRVKLSKKISLPYFRNIVTPVNFNCIDFAEDKDYYFLGHFQELSNIYSIDESLRSEFKPNQEIMNLAHQSKIYELIKQSRGSVALHIRRGDYVTNKNAAEHHGVIGLSYYVNALSYLENVSEFFDVFVFSDDPEWARKNIKNSRNLFFCDEGNCRYSKKYSTIDMYLMSQCDHFIIANSTYSWWAAWLGNYPSKHVVAPARWNANNSPYPILQNWKAIHE

SEQ ID NO: 93 - protein, 285 aa, Firmicutes bacterium CAG:24
MVGVQLSGGLGNQMFEYALYLKLKSMGKDVRIDDVTCYGAQEKQRVNQLSVFGVSYEHMTKQEYEQITDSSMSPLHRARRLLCGRKDLSYREASCNYDPEILRREPALLLGYFQTERYFADIKDQVREAFTFRNLTLTKESAAMEQQMKECESVSVHIRRGDYLTPANQALFGGICDLDYYHRAVAEIRKRKPDVKFFLFSNDMEWTKEHFCGSEFVPVEGNSEQAGEQDLYLMSCCKNHILANSSFSWWGAWLDNGKDKLVIAPEKWMNGRGCCDIYTDEMIRV

SEQ ID NO: 94 - protein, 287 aa, Amphritea japonica
MVKIKIIGGLGNQMFQYAAAKSLAVLNNTRVSANVSVFSNYKTHPLRLNKLNCDCEFDFTRDFRLVLSGFPLLGSAFSKKSMLLNHYVEKDLLFDSSFFDLDDNVLLSGYFQSEKYFSNIRELLIQEFSLDDRLTEAELAINNKIESCNSIAIHIRRGDYITDLSANNIHGICSEEYFEKALNYLDSINVLSDPTTTLFIFSDDILWCKDNLAFKYRTVFVEGSVDRPEVDIHLMSKCKHQVISNSTFSWWGAWLNTNLDKCVIAPLKWFNSLHDSTDIVPKQWMRL

SEQ ID NO: 95 - protein, 273 aa, Bacteroides salyersiae
MKQTIIMSGGLGNQMFQYALYCSMREKGIRVKIDISLYEFNRMHNGYMLDYAFGLNISHNKINKYSVLWTRLIRSNRAPFLLFREDESRFCDDVFTTYKPYIDGCWIDERYFFNIKKKIISQFSFHNIDQKNLMVANMMKVCNSVSLHIRRGDYLSQSMYNICNESYYKSAIEYIISRVEDSKFFIFSDDPEWCKYFMEKFNVDYEIIQHNFGKDSYKDMYLMTQCKHNIIANSTFSWWGAWLNNNAGKNVVCPSVWINGRDFNPCLEEWYHI

SEQ ID NO: 96 - protein, 291 aa, Bacteroides fragilis
MDIILLHNGLGNQMSQYAFYLSKKKNGIHTSYICLSNDHNGIELDKVFGVECQMGCKKIFLLFILRLLMSNRTGFLIRKVNLLFSKIKIKLITENLDYSFHPSFLSASPYCLAFWVGGWHHPQYYSEISSQIKEAFTFKRSLLDERNICIEKRMREPNSVCLHIRRGDYLTGINYELFGKVCNEQYYQKAIDYIEGKLSDICYYVFSNDMEWAKKILLGKNAVFVDWNRGEESWKDMYLMSKCSNLIIPNSTFSWWAAWLCEHPVNIVCPKLFVYGDEQSDIYLDNWHKIE

SEQ ID NO: 97 - protein, 288 aa, Bacteroides nordii
MMGIEKTNMVIVRLWGGIGNQLFQYSFGEFLREKYQVDVIYDIASFGKSDKLRKLELSVVVPGIPVTTDISFSKYVGTKNRLLRFIYGLKNSFIEEKYFSDEQLFKYLSKRGDVYLQGYWQKTIYAETLRRKGSFFLSQEEPIVLHTIKAKIQEAEGAIALHVRRGDYFSSKHINTFGVCDAHYYEKAVDIMRGRVSNAMIFVFSDDLDWVRRYVNLPTNVIYVPNYDIPQYWYIYLMSLCRHNIISNSSFSWWGAFLNMNTNKIVVSPSKWTLNSDKTIALDEWFKI

SEQ ID NO: 98 - protein, 281 aa, Butyrivibrio proteoclasticus
MECSMIIIKFCGALGNQLFQYALYEKMRILGKDVKADISAFGDGNEKRFFYLDELGIEFNIASADEIAEYLNRKTIRFVPGFLQHRHYYFEKKPYVYNKKILSYDDCYLEGYWQNYRYFDDIKDELLKHMKFPCLPLEQKKLAEKMENENSVAVHVRMGDYLNLQDLYGGICDADYYDRAFSYIEGNISNPVYYGFSDDVDKASALLAKHKINWIDYNSEKGAIYDLILMSKCKNNIIANSSFSWWGAYLEYNNGKVVVSPNRWMNCFENSNIAYWGWISL

SEQ ID NO: 99 - protein, 289 aa, Prevotella ruminicola
MRIVKVLGGLGNQMFQFALYKALQKQYPEERVLLDLHCFNGYHKHRGFEIDSVFGVTYEKATLKEVASLAYPYPNYQCWRIGSRILPVRKTMLKEEPNFTLEPSALSLPDSTYYDGYWQHEEYFMHIREEILSTYAFPAFDDERNKTTAQLAASTNSCSIHIRRGDYLTDPLRKGTTNGNYVIAAIKEMQQEVKPEKWLVFSDDIAWCQQHLASTLDATNTIYIDWNTGANSIHDMHLMALCRHHIIANSSFSWWGAWLSQQDGITIAPSNWMNLKDVCSPVPDNWIKI

SEQ ID NO: 100 - protein, 290 aa, Prevotella salivae
MKIIKIIGGLGNQMFQYALAIALQQQYKDEEIRLDLNCFRGYNKHQGYLLDEIFGRRFRAASLQEVARLAWPYPHYQLWRVGSRVLPRRQTMVCEPADGSFSPDVLTLEGNRYYDGYWQDERYFKAYRKEIIEAFKFSPFVGDGNRHVENMLRNERFASLHVRRGDYLNDALYQNTCGIDYYQRAISQMNAMANPSCYFIFSDDIAWCKTHIEPLCEGHRPYYIDWNKGKEAYRDMQLMALCKYHIIANSSFSWWGAWLNDAEDGITIAPQQWYSHGNKPSPASESWIKV

SEQ ID NO: 101 - protein, 293 aa, Lachnospiraceae bacterium COE1
MNIVRISDGLGNQMFQYAYARKISILSRQRTYLDIRFINNEDLVKKGNHVQFRKKLGHRKYGLSHFNVSLQIADLKMLSHWEYLIQSNCMQQLIYSLSMQDKWIWRYRHEEVNYDGMLSKVELLFPTYYQGYFFALKYYDDIKHILQHDFSLKDKMKLLPELRDALYNRNTISLHVRRGDFLEINRDISGSEYYEKAVQMIGSKVESPIFLIFSDDIEWVKEHIRIPNDKIYVSGIGYEDYEELTIMKHCKHNIIANSTFSYWAAYLNSNKDKIVICPKHWRERIIPKDWICI

SEQ ID NO: 102 - protein, 300 aa, Bacteroides dorei
MIVVNVNAGLANQMFHYAFGRGLEAKGWNIYFDQTNFKPRKEWSFENVQLQDAFPNLGLKMMPEGKFKWICVNNTNKLSKGLHLAMINLHNLIGDEKYIFETTYGYDPDIEKEITKNCILKGFWQSEKYFAHCKDDIRKQFSFLPFDEEKNIVIMNKMVKENSVAIHLRKGADYLKSELMGKGLCGVEYYIKAIEYIKKNIDNPVFYVFTDNPVWVKNNLPKFDYILVDWNEVAGKKNFRDMQLMSCAKHNIIANSTYSWWGAWLNPNPNKIVIGPAKFFNPINNFFSSSDIMCEDWVKI

SEQ ID NO: 103 - protein, 288 aa, Roseobacter sp. SK209-2-6
MLSKDPGMITTRLHGRLGNQMFQYAAGRALAARLGVPLALDSRGAKLRGEGVLTRVFDLPLAQPLSLPPLKQDAPLRYAAWRLTGRTPRFRREQGLGYNPAFETWGDDSYLHGYWQSEAYFDSIADQIRQDFTFPEFSNSQNREMAQRIAGSTAISLHVRRGDYVALAAHVLCDQAYYEAALTRILEGVEGSPTVYVFSDDPNWAKENLPLPCEKVVVDFNGPDTDFEDMRLMSLCQHNIIGNSSFSWWAAWLNTHNEKRVAGPAHWFGNPKLQNPDILPESWLKISV

SEQ ID NO: 104 - protein, 285 aa, alpha proteobacterium SCGC AAA076-C03
MIYSRIRGGLGNQLFQYCVARSLADNLGTSLGLDVRDFNENSPYLMGLKHFNIRADFNPPGMIEHKKNGYFRYLIDVVNGKQKFVYKEPHLNFDKNIFSLPNSSYLKGYWQTEKYFIKNKVNILNDLKIISHQSDKNKTISSKIANNTSVSLHIRRGDYISNSAYNSTHGTCSLAYYTNAVNFLVNKIGGNFKVFAFSDDPEWVSSNLKLPVDICFVKNNSSEYNYEDLRLMSECNHNIIANSSFSWWGAWLNTNHNKTVITPCKWYADNSTKNADITPSNWIKI

SEQ ID NO: 105 - protein, 292 aa, Helicobacter bilis
MGGGGQDLRLFELMLYNISLPLCFDYKTLVKYFYSNDKSLKYNFPLQYIRYATRSKYHKLYWLALKHYKYFYDEDPQGDNIVKMYLNNSLEKHAYPFGYFQNLIYFDEIDSIIREEFCLKIPLKPHNQALKEKIEKTENSVFLHVRLGDYLKMEATDGGYVRLGKTYYQSALEILKTRLGQPHIFIFSNDIEWCEKNLCNLLDFTGCHIEFVKANGEGNAAEEMELMRACKHAVIANSTFSWWASYLIDNPDKQIIMPTQVFNDTRRIPKSNMLAKKGYILIDPFWGMHSIV

SEQ ID NO: 106 - protein, 288 aa, Ralstonia sp. GA3-3
MIVTRVIGGLGNQMFQYAAGRALARRLGVPLKIDSSGFADYPLHNYGLHHFALKAVQAGDREIPSGRAENRWAKALRRFGLGTELRVFRERGFAVDPEVMKLPDGTYLDGYWQSESYFAEMTQELRRDFQIATPPTSENAEWLARIGGDEGAVSIHVRRGDYVTNASANAVHGICSLDYYMRAARYVAENIGVKPTFYVFSDDPDWVAGNLHLGHETRYVRHNDSARNYEDLRLMSACRHHIIANSTFSWWGAWLNASEKKVVIAPAQWFRDEKYDTRDLLPPTWTKL

SEQ ID NO: 107 - protein, 289 aa, Bacteroides ovatus
MVVVYIAAGLANKMFQYAFSRGLMSHGLDVFLDQTSFQPEWSFEDIALEEVFPNIEIKNAPNNMFSLAYKKDLLSRIYRRMSAFFPNNRYLMERPFIYDELIYKKATNNCIFCGLWQTELYFNFCERDVRRNFVFTPFQDDQNIKLAEKMKNENSVAIHIRKGADYLKRNIWDGTCSVEYYNQAINYLKEHVSNPVFYLFTDNPEWVEENLKNIDYKLVDWNPVSGKQSYRDMQLMSCAKHNIIANSTYSWWGAWLNNNPQKIVVAPKIWFNPKIEKAPYIIPDRWIRL

SEQ ID NO: 108 - protein, 294 aa, Loktanella vestfoldensis
MIITKLIGGLGNQMFQYAAGRSLAMRHGVPLLLDITELRSYPKHQGYQFEDVFAGRFEIAGLIPLIRVLGRKARKVPKTVAVVSPKWPPMGDHVWVRQRTHDYDAAFESIGADCYLSGFWQSEKYFATIAPQIRESFRFKEALTGANAAIASRMKEAPSAAIHIRRGDYVTDKGAHAFHGLCAWDYYDAAIDHISRHEPDARFFVFSDDVVAAQERFANRQRAEVVAVNSGRHSYRDMMLMAQCKHQIIANSTFSWWAAWLNQNPDKIVVAPGTWFSGNDGQIKDIYCKDWIVI

SEQ ID NO: 109 - protein, 292 aa, Flavobacterium sp. ACAM 123
MDVVIIFNGLGNQMSQYAFYSQKKKINNSTYFVPFCKDHNGLELETVFSLNTKETLIQKSLYILFRILLTDRLKIVSDPLKWILNLFKCKIVKESFNYNYNPEYLKPSKGITFYYGGWHAEKYFAKENQQIKSVFEFTGDLGKINKEHVKDIASTNAVSLHVRRGDFMNEANIGLFGGVSTKAYFEGAIKLIATKVDHPHFFVFSNDMDWVKENLSMDTVTYVTCNSGKDSWKDMCLMSLCQHNIIPNSTFSWWGAWLNKNPHKIVVCPSRFLNNDTYTDIYPDSWVKISDY

SEQ ID NO: 110 - protein, 283 aa, Bacteroides fragilis
MMKLVRMTGGLGNQMFIYAFYIQMKTIFPELRIDMSEMKKYKLHNGYELEDVFSIRPQTISAHKWLKRVIVYAFFSIIREKSEEELSIHKYTQHKRWPLVYYKGFFQSELFFKESSDTIRDIFSFNTENANFRTKEWAKIIKEQRSSVSIHIRRGDYTSAKNKIKYGNICTEEYYQKAISIILKKEPKAFFHIFSDDVEWTKAHLKIHHLPHQYISWNKGPDSWQDMMLMSLCRHNIIANSSFSWWGAWLNAYKDKTVIAPSRWSNVKKTPHILPESWISIDI

SEQ ID NO: 111 - protein, 290 aa, Spirosoma panaciterrae
MIISRVTSGLGNQLFQYAAARSLSLRNKTAFYVDLSYYLYEYPDDTSRSFKLGFFSVPYRILQESPVEYLSKSTKLFPNRSLRPFFLFLKEKQFHFDPTILQAHAGCVIMEGFWQSECYFRDHAEIIRRELQLSKSPSSEFEGYHQQIQATPVPVSVHVRRGDYVNHPEFSKTFGFIGLDYYKTAIRHLTKTIKNPHFYVFSDDKEWARANLPLPTDSVFVTNTGPSGDVADLVLMSTCHHHIIANSSFSWWGAWLNPNPDKLVITPKLWYKNQPTWNTKDLLPPTWVSL

SEQ ID NO: 112 - protein, 288 aa, Unknown
  uncultured bacterium
MIITKLTGGLGNQLFQYAIGRNLIYINGSDLKLDVSEYDVSNKGNFRHYALDKFNTIQNFASKKETNNFKFGVFKKWLYKSGIVKNKNYFLEKKFNFDKEILKIKDNAFLQGYWQSEKYFIGIRDILLQEFSLKENIELKFGEILKEINESNSVSIHVRRGDYVKNPKNLSFHGVCSPKYYSESTSKIASLIEKPVFFVFSDDIEWVKENLNITFPVVYLSGIKNIKSYEELVLMSKCKHNIIANSSFSWWGAWLNTNQKKIVIAPKRWFNDVKLDTTDLIPENWIRI

SEQ ID NO: 113 - protein, 293 aa, Thermosynechococcus elongatus
MIIVHLCGGLGNQMFQYAAGLAAAHRIGSEVKFDTHWFDATCLHQGLELRRVFGLELPEPSSKDLRKVLGACVHPAVRRLLAGHFLHGLRPKSLVIQPHFHYWTGFEHLPDNVYLEGYWQSERYFSNIADIIRQQFRFVEPLDPHNAALMDEMQSGVSVSLHIRRGDYFNNPQMRRVHGVDLSEYYPAAVATMIEKTNAERFYVFSDDPQWVLEHLKLPVSYTVVDHNRGAASYRDMQLMSACRHHIIANSTFSWWGAWLNPRPDKVVIAPRHWFNVDVFDTRDLYCPGWIVL

SEQ ID NO: 114 - protein, 293 aa, Colwellia piezophila
MKIVKIAGGFGNQLFQYAFYLALDKKYAEQVCLDSLDMAKYRLHNGYELEGIFKLDARYCTEEQRIIVRKDNNIFTKLLSSLKKKLGNNKNYILEPKQEHFTFHEKSFGQANTPTYYKGYWQDVKYLENIEEELKSSLVFPEFELGKNIELANFISSNSSVSLHVRRGDYVQHKAFGGICDLSYYQRAVEQINTLVKDPIFIVFSDDIQWCKDNLNLEKAKFVDWNIGENSFRDMQLMTLCKHNIIANSSFSWWGAWLNANDDKNVICPDKWVHYTSATGVLPSEWIKIKASV

SEQ ID NO: 115 - protein, 289 aa, Prevotella maculosa
MKIVKIIGGLGNQMFQYALAIALQERWKDEEIKLDLHGFNGYHKHQGYQLDMLFGHRFEAATLTDVAQLAWPYPHYQLWRVGSRLLPKRRSMLCEPSKGLLPSDVLKQKGSLYYDGYWQDERYFRAIRPQIMAAFKFPDFTDRRNLETEKRLKASEAVSIHVRRGDYLDDVLFQGTCNIAYYQRAIARLCQLKTPVFCIFSNDMAWCKVHIEPLLHGKEILYVDWNRGKESYRDLQLMTLCRHHIIANSSFSWWGAWLSKAEDGITIAPRHWYAHDAKPSPAAERWIKV

SEQ ID NO: 116 - protein, 298 aa, Salmonella enterica
MYSCLSGGLGNQMFQYAAAYILKQYFQSTTLVLDDSYYYSQPKRDTVRSLELNQFNISYDRFSFADEKEKIKLLRKFKRNPFPKQISEILSIALFGKYALSDRAFYTFETIKNIDKACLFSFYQDADLLNKHKQLILPLFELRDDLLDICKNLELYSLIQRSNNTTALHIRRGDYVTNQHAAKYHGVLDISYYNHAMEYVERERGKQNFIIFSDDVRWAQKAFLENDNCYVINNSDYDFSAIDMYLMSLCKNNIIANSTYSWWGAWLNKYEDKLVISPKQWFLGNNETSLRNASWITL

SEQ ID NO: 117 - protein, 279 aa, Bacteroides sp. 3_2_5
MKKVIFSGGLGNQMFQYAFYLFLKKKGIKAVIDNSLYSEFKMHNGFELIKVFDIKESIYRTYFLKVHLIFIKLLMKIPPVRKLSCKDDVIPIGDHEFDPPYARFYLGYWQSKKIVNYVIEELRAQFIFRNIPQMTIEKGDFLSSINSVSIHIRRGDYMGIPAYQGICNEIYYERAISFMKEHFLNPRFYVFSNDSIWAKLFLEKFDIDMEIIVTPPIYSYWDMYLMSRCRNHIIANSTFSWWAAVLNINKDKIVISPTIFKKDECIDIIFDDWVKISNI

SEQ ID NO: 118 - protein, 293 aa, Clostridium sp. CAG:510
MIMLQMTGGMGNQMFTYALYRSLRQKGKEVCIEDFTHYDTPEKNCLQTVFHLDYRKADREVYQRLTDSEPDFLHKVKRKLTGRKEKIYQEKDAIIFEPEVFQTDDVYMIGYFQSGRYFEKAVFDLRKDFTFAWNTFPEKAKKLREQMQAESSVSLHIRRGDYMNGKFASIYGNICTDAYYEAARRYMKEHFGDCRFYLFTDDAEWGRQQESEDTVYVDASEGAGAYVDMALMSCCRHHIIANSSFSWWGAWLDENPDKTVIAPAKWLNISEGKDIYAGLCNCLIDANGSVQGE

SEQ ID NO: 119 - protein, 311 aa, Rhodopirellula europaea
MIVTRLIGGLGNQLFQYAFGHSLARSTYQTLLIDDSAFIDYRLHPLAIDHFTISASRLSDADRSRVPGKFLRTPVGRALDKVSRFVPGYQGVLPVRREKPFGFRESLLARESDLYLDGYWQSEKFFPGLRGSLREEFQLREQPSETTRRLSAQMKSENSVAIHVRRGDYVTSAKAKQIYRTLDADYYRRCLLDLAAHETDLKLYLFSNDVPWCESNLDVGIPFTPVQHTDGATAHEDLHLIAQCRHVVIANSTFSWWGAYLGQLHPTRRVYYPEPWFHPGTLDGSAMGCDDWISEASLEEQSSLKSSRRAA

SEQ ID NO: 120 - protein, 297 aa, Unknown
  uncultured bacterium
MIIVKLKGGMGNQMFQYAIGRNLATKLGTQLRLDLTFLLDRSPRKDFVFRDYDLDIFALDVAFAGPTDLKPFTQFRISHLTKIYNIFPRLLGRPYVISEPHFHFSEAILKSSDNVYLDGYWQSEKYFKEIENSIRDDFKFRQPLEGRAAEMAAQIKNEDRAVCLNVRRADFVTSKKAQEFHGFIGLDYYQKAVDLLVSKVGPLHLFIFSDDVDWCAANLKFNYPTTFVTKDYSGKKYEAYLQLMTLCRHYIIPNSTFAWWGAWLNSDPNKIVIAPKQWFKEASIDTTDIIPSTWIRL

SEQ ID NO: 121 - protein, 292 aa, Bacillus cereus
MIIVKLKGGLGNQMFQYALGKSLALYYDKPLKIDADYIKNNEGYVPRDFSLSKFNIELDLYQEADKERVGFILKNNFLAKKLRNYFLKKGKYKGKYIIENPDNLGLFKKELFENHNESMYIDGYWQSYLYFNNIRECLIKEFNLKPEYTKEMTEIMQRINETNSVAVHIRRGDYVKLGWTLDTTYYKKAIAEIVKNVDNPKFYVFSDDTDWVRSNLQELDNAVFIGECNLFDYQELWLMSTCKHNIISNSTFSWWGAWLNQNDHQVVVSPSAWINGMSVETTSLIPDSWKRV

SEQ ID NO: 122 - protein, 302 aa, Firmicutes bacterium CAG:95
MDIIRMEGGLGNQLFQYALYRQLQFMGRTVKMDVTTEYGREHDRQQMLWAFDVHYEEATQEEINRLTDGFMDLPSRIRRKLTGRRTKKYAEADSNFDPQVLLKTPVYLTGYFQSEKYFKDVEGILHTELGFSDRIYDGISEVFADQIRNYQKQIRETESVSLHVRRGDYLEHPEIYGMSCTMEYYQAGVRYIRERHPDAEIFVFTNDPVFTEKWLQENFLGDFTLIQGTSEETGYLDLMLMSQCKHQIMANSSFSWWGAWLNPNKDKIVVAPEPWFGDRNFHDIYTEEMIRISPRGEVKKHG

SEQ ID NO: 123 - protein, 296 aa, Prevotella oris
MIAATLFGGLGNQMFIYATVKALSLHYQVPMAFNLNHGFANDYKYHRKLELCKFNCQLPTAKWITFDYRGELNIKRISRRIGRNLLCPNYQFVIEEEPFHYEKRLFEFTNKNIFLEGYWQSPCYFENYSKEIRADFQLKVPLSKEMLEEIYALKATGKTLVMLGIRRYQEVEGRDICTYKLCDKEYYIKAITYIQERIPNALFVVFTQDKEWATTHLPKGAEFYFVKDKQDEYATVADMFLMTQCTHAIISNSTFYWWGAWLQCTTKNHIVIAPDSFINSDCVCKEWIILKRNSLC

SEQ ID NO: 124 - protein, 302 aa, Escherichia coli
MYSCLSGGLGNQMFQYAAAYILQRKLKQRSLVLDDSYFLDCSNRDTRRRFELNQFNICYDRLTTSKEKKEISIIRHVNRYRLPLFVTNSIFGVLLKKNYLPEAKFYEFLNNCKLQVKNGYCLFSYFQDATLIDSHRDMILPLFQINEDLLHLCNDLHIYKKVICENANTTSLHIRRGDYITNPHASKFHGVLPMDYYEKAIRYIEDVQGEQVIIVFSDDVKWAENTFANQPNYYVVNNSECEYSAIDMFLMSKCKNNIIANSTYSWWGAWLNTFEDKIVVSPRKWFAGNNKSKLTMDSWINL

SEQ ID NO: 125 - protein, 2102 aa, Leeia oryzae
MIIVKIIGGLGNQMMQYAFAHACAKRLGVPFKLDITAFESYKLWPYGLHNFEITAPIASLEEIEHAKSMGVITETSFRFDDSLVSAVKDGMYLDGYWADYRYSESVWGELKPVFTLMDPLTPEQQALAMNLSAPNAVALHVRRGDYVTNPNCFLLPQQYYRDAIKLVLDQQPDAVFYCFSDDPDWVEAHLDIPAPKVVVRGQGIDNGFVDMILMSKARHRIVANSTFSIWASRLADQDGLTIVPSQFFRKDDPWLLQVYGEVLQPCYPPQWRVVDVTGDGKKEAENTSTALLQIAGGDVRGRKLRIGVWGFYEEFYQNNYIFLNKNAPIGHELLKPFNQLYQYGQAHNLEFVTLDLVADLSTLDAVLFFDAPNMRSPLVSSVMQLDIKKYLCLLECELIKPDNWQQSLHELFTRIFTWHDGLVDNHRYIKVNYVTDLMPWIESAQSLTAPFEETARKGYLQKKLICNISGNKLVSHPFELYSKRIEVIRWFESHHPEHFDLYGMGWSASDYPSYKGKIDDKLEVLKGYRFSLCYENAKELPGYITEKIIDCFKAGVVPVYSGAPNIADWIPDNCFIDSGKFPDTDALYTYLISMTEEVHADYLENIRQFFLGGKAYPFSADAFINTITRTIVQDCLFPHERTDVSVVVPNYNHGNFVVSAITSALNQNVSVELLVLDNASTDDSWSQLQFFADYPQVRLIRNRWNIGVQHNWNHATWLATGRYVVMLSADDLLLPGHLEQAVKRLDENPASSLYYTPCLWINEHDQPLGTLNHPGHLESDYVGGRDEISDLLKFDSYITPSAAVIRRETLNRIGSMNLHLKGAIDWDLWIRIAEISPAFIFRKQPGVCYRQHSGNNSVDFYASTAPLEDHIRIVESIIDRKVAVKYLLKAKEEIIAHLDNRASSYPENQIQHLLSRINNIKDYLRKGAGPVISVIIPTKNRPGLLANALESLTYQTFKDFEVVIHNDGGCDIGGIVDFFSDQLQISYVRSSQSGGAAASRNRALKLAKGRIIAYLDDDDVYLDSHLEKLVDAYKGRSEKFIYTNCEYLIQERKEGRLIELGRERRYAGISYSRAQLLVSNFIPTPTWSHTKELIDTIGDFDESLEILEDWDFLLRASKVTEFYQVNATTVEVRSDRSRDDHTLRANADKLLAYHQKIYAKHPVENESILANRQSLINSLSNRQDVTPKNENSYQGWVNARQPNELAVQILAERMMLQWSKQYQFMIVMVVKQSQQNLLANTIDSFCQQLYSGWKLIVISDFEAPDESFINNEVLGWLTLETVEDENLLTQAFNGVLAEVPSDWVTILPVGTRLTSTALLKVGDRLLLNGGACVIYTDHDYVSDDGMIKDPVLKPAFNLDMLRSQDYIGSSIFFRTDSLAAVGGFASFPGARTYEACFRMLDNYGPQTIEHLPEPVMTFPENQPENSLRVAAMQLALEEHLHRNNISASIEEGYVTGTFLVQYHHSEQPFVSIIIPNKDKHEFLAPCIETLMKVTQYPAFEVIIVDNQSTDPDTLSYYEEIESRFANNVKVIQYDNPFNFSAQCNLGAESARGDFILFLNNDTEIVQANWLERMMQHAQRNDVGVVGARLVFPETVTIQHAGIVLGGKYPDEVFQFPYMNFPVDKDVSLNRTKVVQNYSAVTGACLLVRKSLYQQVGGMNEQNLAVLYGDVDLCLRIRQLHKSVVWTPFSTLVHHTGKTLNSNSDHEKHLMMVIQTRQEREYMLSHWLDIIANDPYYHRLLDKSECNGTIDCTHTPLWDDIPSARPRLQGMALVGGSGEYRVNMPFRTLERSALAEIVLSNMTSKARLPSITELARNAPDVFVVQNALADEFIRMLEMYKKYLPSVFRIQMLDDLLTEIPDASSFKRHFQKNWRDAKARLRKSLKFCDRLIVSTEPLRTFAEDMIDDIIVVPNMLERSVWGDLVSKRRAGKKPRVGWVGAQQHAGDLALMTDVVKATGHEVDWVFQGMCPDDIRPYVAEVNTEWLTYDKYPQGIAALNLDLAIAPLEINAFNEAKSNLRLLEYGALGWPVICTDIYPYQTNNAPVCRVPNDASAWIEAIRSHIADLDATAQKGDQLRQWVHDHYMIEDHAQEWLSALTRPAGK

SEQ ID NO: 126 - protein, 284 aa, Desulfovibrio africanus
MFQYAAARALSLRHSASLAADLTWFSQQFDVQTTPREYALPAFRLNLPEADKRIVATFRLNPTELRIVSFLRHRICFPSRFLPRHITELSFDYWDGFRDILPPAYLDGYWQSERYFSDYPDIIRADFSMLSISEQAAWMSAKIASVQDSISLHIRRGDYVNSLATRKAHGIDTERYYAKALEWIADRIGAATIFAFSDDPRWVRANFDFGKHKGIVVDGSWTAHEDMHLMSLCSHHIIANSSFSWWGAWLSTSQGITIAPKSWFSNPHIWTPDVCPATWERIPC

SEQ ID NO: 127 - protein, 298 aa, Akkermansia muciniphila CAG:154
MAKGKIIVMRLFGGLGNQLFQYAFLFALSRQGGKARLETSSYEHDDKRVCELHHFRVSLPIEGGPPPWAFRKSRIPACLRSLFAAPKYPHFREEKRHGFDPGLAAPPRRHTYFKGYFQTEQYFLHCREQLCREFRLKTPLTPENARILEDIRSCCSISLHIRRTDYLSNPYLSPPPLEYYLRSMAEMEGRLRAADAPQESLRYFIFSDDIEWARQNLRPALPHVHVDINDGGTGYFDLELMRNCRHHIIANSTFSWWAAWLNEHAEKIVIAPRIWFNREEGDRYHTDDALIPGSWLRI

SEQ ID NO: 128 - protein, 292 aa, Dysgonomonas mossii
MKIVKLQGGLGNQMFQYAIARTLETNKKKDIFLDLSFLRMNNVSTDCFTARDFELSIFPHLRAKKLNSLQEKFLLSDRVRYKFIRKIANINFHKINQLENEIVGIPFGIKNVYLDGFFQSESYFKHIRFDLIKDFEFPELDTRNEALKKTIVNNNSVSIHIRRGDYVHLKNANTYHGVLSLEYYLNCIKRIGEETKEQLSFFIFSDDPEYASKSLSFLPNMQIVDWNLGKNSWKDMALMLACKHHIIANSSFSWWGAWLSERNGITYAPVKWFNNESQYNINNIIPSDWVII

SEQ ID NO: 129 - protein, 291 aa, Prevotella oris
MDIVLIFNGLGNQMSQYAFYMSKKKFVPQSKCMYYKGASNNHNGSELDKLFDIKYSETFFCKLILLLFKLYENIPRLRKYFHILGINIVSEPQNYDYNESILKKKTRFGITLYKGGWHSEKYFLANKQDVLNTFSFKIAKEDKNFIDLAKSIEEDTNSVSLHVRRGDYLNISPTDHYQFGGVATTNYYKNAVSYMLKRNKQAHFYIFSDDITWCKAEYKDLMPTFIECNKKNKSWRDMLLMSLCTNHINANSTFSWWGAWLSTKNGITICPTEFIHNVVTRDIYPETWVQL

SEQ ID NO: 130 - protein, 294 aa, Pseudogulbenkiania ferrooxidans
MIIVRLMGGMGNQLFQYATAFALSKRKSEPLVLDTRFFDHYTLHGGYKLDHFNISARILSKEEESLYPNWQANLLLRYPIIDRAFKKWHVERQFTYQDRIYRMKRGQALLGYWQSELYFQEYRKEISAEFTLKEQSSVTAQQISVAMQGGNSVAVHIRRGDYLSNPSALRTHGICSLGYYNHAMSLLNERINDAQFYIFSDDIAWAKENIKIGKTSKNLIFIEGESVETDFWLMTQSKHHIIANSTFSWWGAWLANNTDEQLVICPSPWFDDKNLSETDLIPKSWIRLNKDLPV

SEQ ID NO: 131 - protein, 298 aa, Salmonella enterica
MYSCLSGGLGNQMFQYAAAYILKQYFQSTTLVLDDSYYYSQPKRDTVRSLELNQFNISYDRFSFTDEKEKIKLLRKFKRNPFPKKISEILSIALFGKYALSDSAFYAVETIKNIDKACLFSFYQDADLLNKHKQLILPLFELRDDLLDICKNLDVYPLILRNNNTTALHIRRGDYLTNQHAAKYHGVLDTSYYNNAMEYVERERGKQNFIIFSDDVKWAQKAFLGNENCYIVNNGDYDYSAIDMYLMSLCKNNIIANSTYSWWGAWLNKSEDKLVISPKQWFLGNNETSLRNASWIIL

SEQ ID NO: 132 - protein, 287 aa, Carnobacterium sp. WN1359
MLIVKVYGGIGNQMFQYSFYKYLQKNNDDVFLDISDYKVHNHHNGFELIDVFNIEVKQADMSKFKGHVSSKNSIFYRLTSKLFKRNILGYSEFMDSNGISIVRNEKILTDHYFIGFWQDVLYLQSVEEEIKEAFNFKNVAIGKQNLELISLSESVESVSVHIRKGDYANNSDLSDICDLEYYEEAMKIIDSKVSEPLYFIFSDDIEWCKQKFGKRDNLIYVDWNIAKKSYIDMLLMSKCKHNIIANSTFSWWGAWLNNNSKKIVICPKTWDRKKNENHLLLNDWIAI

SEQ ID NO: 133 - protein, 291 aa, Prevotella sp. CAG:1185
MMKIIVNMACGLANRMFQYSYYLFLMHKGYNVKVDFYNSAKLAHEKVAWNDIFPKARIEQASFSDILKSGGGSDVISKIRRKYLPFLSSVVNMPTAFDANLPVENKKLQYIIGVFQNANMVEAVEEDVKRCFKFQPFTDERNLKLQNEMQSCESVAIHVRKGKDYAQRIWYQNTCPIEYYQNAIRLISEKVNNPKLYVFTDNPEWVKEHFKDFPYTLVEGNPASGWGSHFDMQLMSVCKHNIISNSTYSWWSAFLNVHNEKIVIGPKVWFNPDSCSEFTSERILCKDWIAV

SEQ ID NO: 134 - protein, 294 aa, Selenomonas sp. CM52
MFQYAMASSVARRAGEILKLDLSWIRQMEKKLSADDIYGLGIFSFDEKFSTSNEVQKFLPSGKFSAKIYRAVNRRMPFSWRRVLEEGGMGWHPQIMEIRRSVYFYMGYWQSEKYFSDFIQEIRKDFTFREEVRQSIEERRPIVEKIRKSDAVSLHIRRGDYAQNPALGEIFLSFTMQYYIDAARYISERVKTPVFFIFSDDIPWAKENLPLPYEVCYIDDNIQTNEREIGHKSKGYEDMYLMTQCQHNIIANSSFSWWGAWLNHNPNKIVVAPKKWCNGSFNYADIVPEQWVKL

SEQ ID NO: 135 - protein, 293 aa, Bacteroides nordii
MEIVFIFNGLGNQMSQYALYLSKRNLGCKVRYAYNIRSLSDHNGFELDRVFGITYPNNLFNKCINIIYRLLFANKYLFLVQKMIYVLRQMNVYSIKEKDNYDYDYKILTRHKGIVLYYGGWHSEKYFLSNADIIKDKFRFNISKLNSESLVLYHRLSSLNAVALHVRRGDYMAPEHYNVFGCVCGIEYYKAAIQYIQSQILNPVFIVFSNDIEWVKENITGIQMIFVDFNKKENSWMDMCLMSCCEHNIISNSTFSWWGAWLNNNKNKIVVCPKYFMSNIDTKDIYPESWIKI

SEQ ID NO: 136 - protein, 276 aa, Parabacteroides merdae
MKKKDIILRVWGGVGNQLFIYAFAKVLSLITDCKVTLDIRTGFANDGYKRVYRLGDFSISLLPALRFYTLLSFAQRKMPYIRHLLAYKFDFFEEDQKYPLETLDSFFKIYSDKNLYLQGYWQYFDFSSYRDVLLKDLRFEVEINNTYLYYSDLIEKSNAVAIHFRRIQYEPVISIDYYKKAIKYISENVENPTFFIFSDDINWCRENLSINGICFFVENFKDELYELKLMSQCNHFIIANSTFSWWGAWLSVNADKKVIMPDGYTDVSMNGSIVHI

SEQ ID NO: 137 - protein, 290 aa, Butyrivibrio sp. NC2007
MIIIQLKGGLGNQMFQYALYKELKHRGRDVKIDDESGFIGDKLRVPVLDRFGVEYDRATKDEVIALTDSKMDIFSRIRRKLTGRKTFRIDEMEGIFDPKILETENAYLVGYWQSEKYFTSPEVIEQIQEAFGKRPQEIMHDSVSWSTLQQIECCESVSIHVRRTDYMDAEHIKIHNLCSEKYYKNAISKIREEHPNAVFFIFTDDKEWCKEHFKGPKFITVELQEGEFTDVADMLLMSRCKHHIIANSSFSWWSAWLNDSPEKIVIAPSKWINNKKMDDIYTERMTKVAI

SEQ ID NO: 138 - protein, 286 aa, Bacteroides ovatus
MIVVYSNAGLANRMFHYALYKALEVKGIDVYFDEKSYVPEWSFETTTLMDVFPNIQYRESLQFKRASKKTFLDKIVIHCSNLFGGRYYVNYRFKYDDKLFTKLETNQDLCLIGLWQSEKYFMDVRQEIQKCFQYRSFVDDKNVKTAQQMLSENSVAIHVRKGADYQQNRIWKNTCTIDYYRLAIDYIRMHVQNPVFYVFTDNKDWVIENFTDLDYTLCDWNPTSGKQNYLDMQLMSCAKHNVIANSTYSWWGAWLNENSDKIVIAPKRWFNKIVTPDILPEQWIKI

SEQ ID NO: 139 - protein, 288 aa, Mesotoga prima MesG1.Ag.4.2;Mesotoga prima
MRVVWFGGGLGNQMFQYGLYCFLKKNNQEVKADCTQYSTTPMNNGFELERLFNLDIAHANLDVISKLTGGNRLSPRKVIWKLFRKPKVYFEEKIPFSFDPDVLKGNNRYLKGYWQNMNYLEPCAKELRDVFTFPAFSSDNNKRLADEIAKVEAVGVHFRRGDFLKSSNLGLFGGICSDQYYLRAIQTMENTVVEPVFYVFCDDPQWAKNSFSDARFTVIDWNIGSNSYRDMQLMSLCKHNIIANSTFSWWAAWLNRNPNRTVIAPERMVNRDLDFSGIFPNDWIRLQG

SEQ ID NO: 140 - protein, 296 aa, Clostridium sp. KLE 1755
MIVLKLQGGLGNQMFEYAFARTIQEQKKDKKLILDTSDFQYDKQREYSLGHFILNENIEIDSSGKFNLWYDQRKNPLLKVGFKFWPKFQFQTLKLFGIYVWDYAKYIPVDVSKKHKNILLHGLWQSDKYFSQISEIIRKEFAVKDEPSQGNKAWLERISSANAVCVHIRRGDFLAKGSVLLTCSNSYYLKAMEIISKKVNEPEFFIFSDDIEDVKKIFEFPGYQITLVNQSNPDYEELRLMSKCKHFIIANSTFSWWSSLLSENEDKVIVAPRLWYSDGRDTSALMRDEWIIIDNE

SEQ ID NO: 141 - protein, 289 aa, Bacteroides plebeius CAG:211
MDLVTLSGGLGNQMFQFAFYWALKKRGKKVFLYKNKLAAKEHNGYELQTLFGVEEKCVDGLWMTRLLGCPLLGKILKHILFPHKIRERVLYNYSIYLPLFERNGLHWVGYWQSEKYFQDVADDIRRIFCFDHLSLNPATSAALKCMSEQVAVSVHIRRGDYYLPCNVATYGGLCTVEYYENAIRYVKERYPQAVFYVFSDDLDWVRENIPSAGKMVFVDWNRGKDSWQDMFLMSKCHHNILANSSFSWWGAWLNTHPEKLVIAPERWANCPAPDALPDGWVRIEGVSRR

SEQ ID NO: 142 - protein, 308 aa, Treponema lecithinolytikum
MAIKIVKISGGLGNQMFCYAFACALQKCGHKVYVDTSLYRKATVHSGIDFCHNGLETERLFGIKFDEADTADVRRLSTSAEGLLNRIRRKYFTKKTHYIDTVFKYTPELLSDKNDCYLEGYWQTEKYFLPIEKDIRRLFTFRPTLSEKSAAVQSALQAQQAAVLSASIHVRRGDFLNTKTLNVCTETYYNNAIKYAVKKHAVSRFYIFSDDIPWCREHLCFCNAHAVFIDWNTGNDSWQDMALMSMCRCNIIANSSFSWWAAWLNNASDKTVLAPAIWNRRQLEYVDRYYGYDYSDIVPESWIRIPID

SEQ ID NO: 143 - protein, 281 aa, Bacteroides eggerthii
MRLIKMTGGLGNQMFIYAFYLRMKKRHTNTRIDLSDMMHYNVHHGYEMHRVFNLPKTEFCINQPLKKVIEFLFFKKIYERKQDPSSLLPFDKKYLWPLLYFKGFYQSERFFADMENDIRIAFTFNSDLFNEKTQAMLTQIKHNEHAVSLHIRRGDYLEPKHWKTTGSVCQLPYYLNAITEMNKRIEQPSYYVFSDDIAWVKENLPLPQAVFIDWNKGAESWQDMMLMSHCRHHIICNSTFSWWGAWLNPRENKTVIMPERWFQHCDTPNIYPDGWIKVPVN

SEQ ID NO: 144 - protein, 287 aa, Bacteroides stercoris
MRFIKMTGGLGNQMFIYAFYMRMKKHYSNTRIDLSDMVHYKAHNGYEMHRVFNLPPIEFRINQPLKKVIEFLFFKKIYERKQVPSSLVPYDKKYFWPLLYFKGFYQSERFFADMADDIRKAFTFNPRLSNRKTKEMSEQIDHDENAVSIHVRRGDYLEPKYWKTTGCVCQLPYYLNAIAEMNKRISQPSYYVFSDDIAWVKENLPLPKAFFIDWNKGAESWQDMMLMSRCRHHIICNSTFSWWGAWLNPRENKTVIMPERWFRHCETPDICPDKWIKVPINQPDSIQ

SEQ ID NO: 145 - protein, 290 aa, Butyrivibrio proteoclasticus
MIIIQLKGGMGNQMFQYALYRQLKKLGREVKIDDETGFVDDELRIPVLQRFGISYDKATREEIVKLTDSKMDIFSRIRRKLTGRKTFRIDEESGIFDPRILEVEDAYLVGYWQSDKYFANEEVEKEIREAFEKRPQEVMQDSVSWTILQQIECCESVSLHIRRTDYIDEEHIHIHNICTEKYYKSAIDEVRNQYPSAVFFIFTDDKDWCRQHFRGPNFFVVDLDEDTNTDIAEMTLMSRCKHHILANSSFSWWAAWLNDNPGKIVIAPSKWINNRKMDDIYTARMKKIAI

SEQ ID NO: 146 - protein, 303 aa, Prevotella oulora
MSPIVHFPSDRLLRYEHLNSLWKTAMIYTRLLARLGNQMFQYAAGRGLAARLGVDFTVDSRRAVHKGDGVLTRVFDLDWAAPENMPPAQHERPLAYYAWRGLRRDPKIYRENGLGYNAAFETLPDNTYLHGYWQCERYFAHIADDIRAAFVPRHPMSAQNADMARRIASGPSVSLHVRRGDYLTVGAHGICDQTYYDAALAAVMQGLPSPTVYVFSDDPQWAKDNLPLTFEKVVVDFNGPDSDYEDMRLMSLCQHNVIANSSFSWWGAWLNANPQKRVAGPANWFSNPKLSNPDILPSRWIRI

SEQ ID NO: 147 - protein, 289 aa, Thalassobacter arenae
MGQDMIYSRIFGGLGNQLFQYATARAVSLRQGVELVLDTRLAPPGSHWAFGLDHFNISARIAEPSELPPSKDNFFKYVMWRAFGHDPAFMRERGLGYQSRIAQAPDGTYLHGYFQSERYFADVLDHLENELRIVTPPDTRNAEYADRIASAGHTVSLHVRRGDYVETSKSNSTHATCDEAYYLRALARLSEGKSDLKVFVFSDDPEWVRDNLKLPYDTTPVGHNGPDKPHEDLRLMSCCSDHVIANSTFSWWGGWLDRRPEARVVGPAKWFNNPKLVNPDILPERWIAI

SEQ ID NO: 148 - protein, 290 aa, Prevotella oris
MKIIKIIGGLGNQMFQYALAVALQKKWKDEEIKLDLHGFNGYHKHQGYQLDEIFGHRFKAASLKEVAQLAWPYPHYQLWRVGSRLLPKRKTMVCESADCRFQSDLLNLEGSLYYDGYWQDERYFKAFRTEIIEAFKFTPLVGDSNRKVENMLKEGRFASLHVRRGDYLKEPLFQSTCDIAYYQRAISRLNQMADPYCYLIFSNDIAWCKTHIEPLCDGRRTHYVDWNHGKESYRDMQLMTFCKHHIIANSSFSWWGAWLSTANDGITIAPHQWYANDRKPSPAAEAWLKL

SEQ ID NO: 149 - protein, 290 aa, Prevotella oulora
MKIVRIIGGLGNQMFQYALALALKQQQENEEVKLDLSAFRGYKKHGGFQLVQCFGTTLPAATWQEVAQLAWYYPHYQLWRLGHRVLPVCKTMLKEPDNGAFLPEVLQRKGDAYYEGCWQDERYFSHYRPAILQAFTFPTFTNPRNLAMQQQINTTESVAIHVRRGDYLHDALFRNTCGLAYFQRAITCILQHVAHPVFYVFSDDMAWCRQHIQPLLQTNEAVFVDWNHGKASICDLHLMTLCRHHIIANSSFSWWGAWLSPHQAGWIIAPKQWYAHEEKMSPAAERWLKL

SEQ ID NO: 150 - protein, 298 aa, Spirosoma panaciterrae
MNRRVAVQLKGGLGNQLFQYALGRRLSLQLEAELLFDCSVLENRIPVTNFTFRSFDLDMFRIAGRVATPSDLPLFPKSASIRSPWPHLVQLARLWKQGYSYVYERGFAYNPKMLRQLSDRVYLNGYWQSYRYFEDIAATLRADCSFPDPLPDSAVGLAGQINATNSICLHIRRTDFLQVPLHQVSNADYVGRAIAYMAERVNDPHFFVFSDDIAWCQTNLRLSYPVVFVPNELAGPKNSLHFRLMRYCKHFITANSTFSWWAAWLSEPSDGKVIVTPQTWFSDSRSIDDLIPANWIRL

SEQ ID NO: 151 - protein, 267 aa, Butyrivibrio proteoclasticus
MNYVEVKGGLGNQLFQYTFYKYLEKKSGHKVLLHTDFFKNIDSFEEATKRKLGLDRFDCDFVAVSGFISCEKLVKESDYKDSMLSQDEVFYSGYWQNKRFFLEVMDDIRKDLLLKDENIQDEVKELAKELRAVDSVAIHFRRGDYLSEQNKKIFTSLSVDYYQKAIAQLAERNGADLKGYIFTDEPEYVSGIIDQLGSIDIKLMPVREDYEDLYLMSCARHHIIANSSFSWWGAALGDTESGITIAPAKWYVDGRTPDLYLRNWISI

SEQ ID NO: 152 - protein, 290 aa, Butyrivibrio sp. XPD2006
MIIIQLKGGLGNQMFQYALYKELKHRGREVKIDDVSGFVNDKLRVPVLDRFGVEYERATREEVVELTDSRMDIFSRIRRKLTGRKTYRIDEMEGIFDPAILETENAYLVGYWQSEKYFTSPEVIEQIQEAFGKRPQEIMHDSVSWSTLQQIECCESVSIHVRRTDYVDAEHIKIHNLCSEKYYKNAIGKIREKHPNAVFFIFTDDKEWCKDHFKGPNFITVELQEGEFTDVADMLLMSRCKHHIIANSSFSWWSAWLNDSPEKMVIAPSKWINNKKMDDIYTERMTRVAI

SEQ ID NO: 153 - protein, 306 aa, Bacteroides sp. 1_1_6
MKIVNITGGLGNQMFQYAFAMALKYRNPQEEVFVDIQHYNTIFFKKFKGINLHNGYEIDKVFPKAKLPVAGVRQLMKFSYWIPNYILSRLGRKFLPIRKKEYIPPYSMNYSYDEKALNWKGDGYFEGYWQSYNHFGDIKEELQKVYAHPKPNQYNAALISNLESCNSVGIHVRRGDYLAEPEFRGICGLDYYEKGIKEILSDEKKYVFFIFSNDMQWCQENIAPLVGDNRIVFISGNKGKDSCWDMFLMTHCKDLIIANSSFSWWGAFLNKKVDRVICPKPWLNRDCNIDIYNPSWILVPCYSEDW

SEQ ID NO: 154 - protein, 271 aa, Bacteroides fragilis
MKIVTFQGGLGNQLFQYVFYLWLDMRCDKDNIYGYYPKKGLRAHNGLEIEKVFEVKLPNSSLSTDLIVKSIKLINKIFKNRQYISTDGRLDVNGVLFEGFWQDKYFWEDVDIVLNFRWPLKLDVTNSFIMTKIQANNSISIHIRRGDYLLPKYRNIYGDICNEEYYQKAIEYILKCVDDPFFFVFSDDIDWAKSIINVSNVTFVNNNKGKDSYIDMFLMSLCHHNIIANSTFSWWAAQLNKHSDKIMIAPIRWFKSLFKDPNIFTESWIRI

SEQ ID NO: 155 - protein, 266 aa, Bacteroides sp. 9_1_42FAA
MIKIVSFSGGLGNQLFQYLLVVYLRECGHQVYGYYNRKWLIGHNGLEVNNVFDIYLPKTNFIVNALVKVIRVLRCLGFKKYVATDTYNNPIAIFYDGYWQDQKYFNIIDSKLSFKKFDLSAENKSILSKIKSNISVALHIRCGDYLSSSNVEIYGGVCTKEYYEKALELVCKIKNVMFFVFSDDIEYAKLLLNLPNAIYVNANVGNSSFIDMYLMANCKVNVIANSTFSYWAARLNQDNILTIYPKKWYNSKYAVPDIFPSEWVGV

SEQ ID NO: 156 - protein, 298 aa, Coraliomargarita sp. CAG:312
MIIVKVQGGLGNQMFQYAFGRALSEKHSQDLYLDCSEYLRPSCKREYGLDHFNIRAKKASCGDVKSMVTPHFALRKKLKKIFAVPYSLSPTHILERNFNFQPSILEFNCGYFDGFWQTQKYFSGISDIVRKDLTFKDAVKYSGGETFAKITSLNSVSLHIRRGDYVKVKRTRKRFSVIRAGYFKRAVEYMRSKLDTPHFFIFTDDPKWVSENFPAGEDYTLVSSSGMYEDLFLMAQCRHNIIFNSSFSWWGAWLNGNPGKIVVAPDMWFTPHYKLDYSDVVPEEWIKLNTGYFESKEF

SEQ ID NO: 157 - protein, 289 aa, Pseudorhodobacter ferrugineus
MIVMQIKGGLGNQMFQYAAGRALSLQTGMPLHLDLRYYRREREHGYGLGAFNIEASPLDESLLPPLPRESPLAWLIWRLGRRGPNLVRENGMGFNPTLSNVTKPAWITGYFQSERYFAAHAATIRAELTPVAAPDLVNARWLAEIAAEPRAVSLHVRRGDYVRDAKAAAKHGSCTPAYYERALAHITARMGTAPVVYAFSDDPAWVRENLRLPAEIRVPGHNDTAGNVEDLRLMSACRHHIVANSSFSWWGAWLNPRADKIVASPARWFADPAFTNPDIWPEAWARIEG

SEQ ID NO: 158 - protein, 299 aa, Escherichia coli
MMYCCLSGGLGNQMFQYAAAYILKQHFPDTILVLDDSYYFNQPQKDTIRHLELDQFKIIFDRFSSKDEKVKINRLRKHKKIPLLNSFLQFTAIKLCNKYSLNDASYYNPESIKNIDVACLFSFYQDSKLLNEHRDLILPLFEIRDDLRVLCHNLQIYSLITDSKNITSIHVRRGDYVNNKHAAKFHGTLSMDYYISAMEYIESECGSQTFIIFTDDVIWAKEKFSKYSNCLVADADENKFSVIDMYLMSLCNNNIIANSTYSWWGAWLNRSEDKLVIAPKQWYISGNECSLKNENWIAM

SEQ ID NO: 159 - protein, 299 aa, Lachnospiraceae bacterium 3_1_57FAA_CT1
MIIIKVMGGLGNQMQQYALYEKFKSIGKNVKLDISWFEDSSVQEKVFARRSLELRQFKDLQFDTCSAEEKEALLGKSGILGKLERKLIPARNKHFYESDIYHSEVFNMSDAYLEGHWACEKYYHDIMPLLQEKIQFPESANSQNITVKKRMKAENSVSIHIRRGDYLDPENEAMFGGICTNSYYKAAEEYIKSRVPDTHFYLFSDDTAYLRENYHGDEYTIVDWNKGEDSFYDMELMSCCRHNICANSTFSFWGARLNRTPDKIVIRPAKHKNSQEIEPQLLHELWDNWVIIDGDGRIV

SEQ ID NO: 160 - protein, 733 aa, Butyrivibrio fibrisolvens
MKPLVSLIVPVLNVEKYLEQCLTSISSQTYDNFEVILVVGKCIDNSENICKKWCEKDHRFRIEPQLKSCLGYARNVGIDAAKGEYIAFCDSDDCITSDFLSCFVDTALKNSSDIVETQFTLCDQNLSPIYDYDRNILGHILGHGFLEYTSAPSVWKYFVKRDIFTSNNLHYPEIRFGEDISMYSLLFSYCNKIDYVEKPTYLYRQVPSSLMNNPQGKRKRYESLFDIIDFVTNEFKTRLLFQKSWLKLLFQLEMHSASIISDSATSDDEAISMRQEISGYLKKVFPVKNTIFEVTALGWGGEIVSSIASKFNTLHGVSSSNMFNRYFFELLEDSTRKKLEEMIINFSPDIFLIDLISEADYLSSYKGNLGTFVKNWKIGFSIFMKMIQTHSNNSSIFLLENYMQQAPDHVDNTNEILKMLYDDIKINHPDIICISPAPDILNRSSEPELPCIYQLKLVSDKLHTMYSPVINCVETKGGLGNQIFQYVFSKYIEKMTGYRPLLHIGFFDYVKAIPGGTKRIFSLDKLFPDIETTSGKIPCSHVVEEKSFISNPGSDIFYRGYWQDIRYFSDVKDEVLESFNVDTSSMSKDVIDFADTIRNANSIAMHIRRQDYLNENNVSLFEQLSIDYYKSAVDMIRKEYADDLVLFIFSDDPEYANSIADSFDIEGFVMPLHKDYEDLYLITLAHHHIIANSTFSLWGALLSARKDGIRIAPRNWFKGTPATNLYPDKWLIL

SEQ ID NO: 161 - protein, 286 aa, Anaeromusa acidaminophila
MFCVRIYGGLGNQMFQYALGRAMAKHYSETAAFDLSWYEQKIKPGFEASVCQYNIELSRKDRPKAWYEPILKRISRHTDKLEMWFGLFFEKKYHYDSTVFERGLCKKNITLDGYWQSYKYFSAIEDDLRRELTIPKEREELIAISRSLPENSVSIHVRRGDYVSNPKANAMHGTCSWEYYQAAIEKMTGLVKEPQYVVFSDDITWTKENLPLPNAMYIGRELGLFDYEELILMSRCKHNIMANSTFSWWGAWLNSNPNKVVIAPRKWFRHKKIKVNDLFPSSWVVL

SEQ ID NO: 162 - protein, 292 aa, Bacteroides sp. 2_1_16
MDIVVIFNGLGNQMSQYAFYLAKKKDNLNCHVIFDPKSTNVHNGAELKRVFGIELNRNYLDKIISYFYGYIFNKRIVNKLFSLVGIRMIYEPKNYDYREELLKPSSNFISFYWGGWHSEKYFKDIELEVKKVFKFPEVTNSPYFTEWFNKIFLDNNSVSIHIRRGDYLDKPSDPYYQFNGVCTIDYYEKAILYLKERILEPNFYIFSNDINWCMKTFGTENMYYVDCNKGKDSWRDMYLMSECRHHINANSTFSWWAAWLSPYSNGIVLHPKYFIKDIETKDYYPQKWIMIE

SEQ ID NO: 163 - protein, 283 aa, Chlorobium phaeobacteroides
MDKVVVHLTGGLGNQMFQYALGRSISINRNCPLLLNTSFYDTYDKFSCGLSRYNVKAEFIKKNSYYNNKYYRYVIRLLSRYGVACYFGSYYEKKIFSYDEKVYKRSCVSYYGTWQSYGYFDSIRDILLRDYEMVGCLEEEVEKYVSDIKRVDSVSLHIRRGDYFDNKRLQSIHGILTMEYYYKAMSLFPDSSVFYVFSDDIEWVRENLITNTNIVYVVLESDNPENEIYLMSLCKNNIISNSTFSWWGAWLNKNKYKKVIAPRMWYKDNQSSSDLMPSDWCLI

SEQ ID NO: 164 - protein, 297 aa, Treponema bryantii
MIVISMGGGLGNQMFEYAFYTQLKHLYPKSEIKVDTKYAFPYSHNGIEVFKIFGLNPPEANWKEVHSLVKTYPIEGNKAHFIKFFLYRILRKANLVEREPTSFCKQKDFTEFYNSFFELPQNKSFYLYGPFVNYNYFAAIHNEIMDLYTFPEITDVTNIEYKRKIESSHSISIHIRRGDYITEGVPLVPDAYYREALVYINKKIEDPHFFVFTDDKDYCKSLFSDNQNFTIVEGNTGANSFRDMQLMSLCKHNIIANSTFSFWGAFLNKNSEKIVIAPNIAFKDCSCPYICPDWIIL

SEQ ID NO: 165 - protein, 290 aa, Bacteroides fragilis
MVIAKLFGGLGNQMFIYAAAKGIAQISNQKLTFDIYTGFEDDSRFRRVYELKQFNLSVQESRRWMSFRYPLGRILRKISRKIGFCIPLVNFKFIVEKKPYHFQNEIMRIASFSSIYLEGYFQSYKYFSKIEAQIREDFKFTKEVIGSVEKEASFITNSRYTPVAIGVRRYSEMKGEFGELAVVEHDYYDAAIKYIANKVPNLIFIVFSEDIDWVKKNLKLDYPVYFVTSKKGELAAIQDMYLMSLCNHHIISNSSFYWWGAYLASTNNHIVIAPSVFLNKDCTPIDWVII

SEQ ID NO: 166 - protein, 314 aa, Firmicutes bacterium CAG:534
MSGGLGNQMFQYALYMKLTAMGREVKFDDINEYRGEKAWPIMLAVFGIEYPRATWDEIVAFTDGSMDFSKRLKRLFRGRHPIEYVEQGFYDPKVLSFENMYLKGSFQSQRYFEDILEEVQETFRFPELKDMNLPAPLYETTEKYLLRIEGCNAVGLHMYRGDSRSNEELYDGICTEKYYEGAVRFIQDKCPDAKFFIFSNEPKWVKGWVISLMKSQIREDMSREEIRALEDHFVLIENNTEYTGYLDMFLMSRCRHNIISNSSFSWWAAFINENPDKLVTAPSRWVNGVPSEDVYVKGMTLIDEKGRVERTIKE

SEQ ID NO: 167 - protein, 279 aa, Firmicutes bacterium CAG:882
MVIVKIGDGLGNQMFNYVCGYSVAKHDNDTLLLDTSDVDNSTLRTYDLDKFNIDFTDRESFTNKGFFHKVYKRLRRSLKYNVIYESRTENCPCVLDVYRRKFIRDKYLHGYFQNLCYFKTCKEDIMRQFTPKEPFSAKADELIHRFATENTCSVHVRGGDIKPLSIKYYKDALDKIGEAKKDMRFIVFSNVRNLAEEYIKELGVDAEFIWDLGEFTDIEELFLMKACRRHILSDSTFSRWAALLDEKSEEVFVPFSPDADKIYMPEWIMEEYDGNEEKR

SEQ ID NO: 168 - protein, 287 aa, Vibrio parahaemolyticus
MVIVKVSGGLGNQLFQYAIGCAISNRLSCELLLDTSFYPKQSLRKYELDKFNIKAKVATQKEVFSCGGGDDLLSRFLRKLNLSSLFFPNYIKEKESLVYLAEISHCKSGSFLDGYWQNPQYFSDIKDELVKQIVPIMPLSSPALEWQNIIINTKNCVSLHVRRGDYVNNAHTNSVHGVCDLSYYREAITNIHETVEKPKFFVFSDDISWCKDNLGSLGHFTYVDNTLSAIDDLMLMSFCEHHIIANSTFSWWGAWLNDHGITIAPKRWFSSVERNNKDLFPEKWLIL

SEQ ID NO: 169 - protein, 286 aa, Herbaspirillum frisingense
MIVSRLIGGLGNQMFQYAAGRALALRRGVPFAIDSRAFADYKTHAFGMQCFCADQTEAPSRLLPNPPAEGRLQRLLRRFLPNPLRVYTEKTFTFDEAVLSLPDGIYLDGYWQSEKYFADFADDIRKDFAVKAAPSAPNQAWLELIGRTHSVSLHIRRGDYVSNAAAAAVHGTCDLGYYERAVAHLHQVTGQAPELFVFSDDLDWVATNLQLPYTMHLVRDNDAATNFEDLRLMTACRHHIVANSSFSWWGAWLDGRSESITIAPARWFVADTPDARDLVPQRWVRL

SEQ ID NO: 170 - protein, 288 aa, Rhizobium sp. CF080
MIITRILGGLGNQMFQYAAGRALAIANEAELKLDLIEMGAYKLRPFALDQFNIKAAIAQPDEVPAKPKRGLLRKFTSAFKPDRSSCERIVENGLTFDSRVPALRGSLHLSGYWQSEQYFASSADAIRSDFSLKSPLGPARQDVLARIGAATTPVSIHVRRGDYVTNPSANAVHGTCEPPWYHEAMRRMLDRAGDASFFVFSDEPQWARDNLQSSRPMVFIEPQNNGRDGEDMHLMAACHAHIIANSSFSWWGAWLNPRPNKHVIAPRQWFRAPDKDDRDIVPATWERL

SEQ ID NO: 171 - protein, 328 aa, Verrucomicrobium spinosum
MVISHISEGLGNQMFQYAAGRRLSYHLGTTLKLDDYHYRLHPFRSFQLDRFLITSPIATDAEISHLCPLEGLARAIRARLPGKLRGATLRLLGNLGLGSPYQPRLHSFKEETPKQPLLIGKVVSERHFHFDPDVLECPDNVCLVGYWQDERYFGEIRDILLRELTLKSPPAGATKAVLERIQRSSSVSLHVRRGDKTKSSSYHCTSLEYCLAAMSEMRARLQAPTFFVFSDDWDWVREQIPCSSSVIHVDHNRAEDVSEDFRLMKSCDHHIIASSSLSWWAAWLGTNENSFVFSPPADRWLNFSNHFTADVLPPHWIQLDGSSLLPAQ

SEQ ID NO: 172 - protein, 300 aa, Fibrella aestuarina
MTANRVLVNSPMVIAKITSGLGNQLFQYALGRHLALQGNTSLWFDLRYFHQEYATDTPRKFKLDRFNVRYNLLDSSPWLYASKATRLLPGRSLRPLIDTRFEADFHFDPTVIRPAAPLTILWGFWQSEKYFAQSTPQIRQELTFNRPLSDTFVGYQQQIEQAEVPISVHVRRGDYVTHPEFSQSFGFVGLAYYQKALAHLQDLFPNATLFFFSDDPDWVRANIVTEQPHVFVQNSGPDADVDDLQLMSLCHHHVIANSSFSWWGAWLNPRPDKVVIGPQRWFANKPWDTKDLLPSGWLRL

SEQ ID NO: 173 - protein, 287 aa, Rhodobacter sp. CACIA14H1
MIHMRLVGGLGNQLFQYACGRAVALRHGTELVLDTRELSRGAAHAVFGLDHFAIRARMGASADLPPPRSRVLAYGLWRAGFMAPRFLRERGLGVNPAVLAAGDGTYLHGYFQSEAYFRDVVPQIRPELEIVTPPSDDNLRWASRIAGDDRAVSLHVRRGDYVASAKGQQVHGTCDADYYARAVAAIRARAGIDPRLYVFSDDPHWARDNLALDAETVVLDHNPPGAAVEDMRLMGVCRHHIIANSSFSWWGAWRNPSAGKVVVAPVRWFADPKLHNPDICPPEWLRV

SEQ ID NO: 174 - protein, 316 aa, Rhodopirellula baltica
MATSAHLHLSDEKQTLDSKASDRDCATTEASASDKTCTISISGGLGNQMLQYAAGRALSIHHDCSLQLDLKFYSSKRHRSYELDAFPIQAHRSIKPSFFSQILSKIQSESKHVPTYQEQSKRFDPAFFNTEPPVKIRGYFFSEKYFSPYADQIRTELTPPIPPDQPARDMAIRLKECVSTSLHVRRGDYVTNANARQRFWCCTSEYFEAAIERLPTDSTVFVFSDDIEWAKQNIRSSRTTVYVNDELKKAGSPETGLRDLWLMTHAKSHIIANSSFSWWGAWLANSEANLTIAPKKWFNDPEIDDSDIVPSSWHRI

SEQ ID NO: 175 - protein, 286 aa, Spirosoma spitsbergense
MVVVELMGGLGNQMFQYAFGMQLAHQRQDTLTVSTFLLSNKLLANLRNYTYRPFELCIFGIDKPKASPFNLLRALLPFDLNTSLLRETDDPEAVIPAASARIVCVGYWQSEHYFEEVTVHVREKFIFRQPFNSFTSRLANNLNGIPNSVFVHIRRGDYVTNKGANAHHGLCDRTYYERAVTFMREHLENPLFFIFSDDLEWVSQELGPILEPATYVGGNQKNDSWQDMYLMSLCRHAIVANSSFSWWGAWLSPHASKIVVAPKEWFGKPLLPVKTNDLIPNSWIRI

SEQ ID NO: 176 - protein, 295 aa, Unknown
  uncultured bacterium
MNAIIPRLTGGIGNQLFIYAAARRMAIANSMNLVIDDTSGFKYDVLYKRFYQLEKFNITSRMATPTERLEPFSKIRRYLKRKINKTYPFAQRAYITQEKSGFDPRLLVFRPKGNVYLDGYWQSENYFKDIEGIIRQDLIIKSPSDSLNIATAERIKNTLAIAVHVRFFDMVDISDSSNCQSNYYHTAIAKMEEKIPNAHYFIFSDKPVLARLAMPLPDDRITIIDHNIGDMNAYADLWLMSLCKHFVIANSTFSWWGAWLSDNKEKIVIAPDIKITSGVTQWGFDGLIPDEWIKL

SEQ ID NO: 177 - protein, 289 aa, Prevotella micans
MDVIVIFNGLGNQMSQYAFYLEKRLRNRQTTYFVLNPRSTYELERLFGIPYRSNLMCRMIYKLLDKAYFSNHIRLKKILRTALNAVGIRLIVEPITRNYSLSNFTHHPGLTFYRGGWHSELNFTSVVTELRRKFIFPPSDDEEFKRISALIIRTQSISLHIRRGDYLDYSEYQGVCTEEYYERAIEYIRSHVENPVFFVFSDDKEYAINKFSGDDSFRIVDFNTGENSWRDMQLMSLCRHHILANSTFSWWGAWLDSAPEKIVLHPIYHMRDVPTRDFYPHNWIGISGE

SEQ ID NO: 178 - protein, 293 aa, Thermosynechococcus sp. NK55
MIIVRLYGGLGNQMFQYAAGLALSLRHAVPLRFDLDWFDGVRLHQGLELHRVFDLDLPRAAPSEMRQVLGSFSHPLVRRLLVRRRLRWLLPQGYALEPHFHYWPGFEALGPKAYLDGYWQSERYFSEYQDAVRAAFRFAQPLDERNRQIVEEMAACESVSLHVRRGDFVQDPVVRRVHGVDLSAYYPRAVALLMERMREPRFYVFSDDPDWVRANLKLPAPMIVIDHNRGEHSFRDMQLMSACRHHILANSSFSWWGAWLNSQPHKLVIAPKRWFNVDDFDTRDLYCSGWTVL

SEQ ID NO: 179 - protein, 309 aa, Coleofasciculus chthonoplastes
MLSLNKNFLFVHIPKSCILKEVYIYMISFPNLGKGVRLGNQMFQYAFLRSTARRLGVKFYCPAWSGDSLFTLNDQEERVSQPEGITKQYRQGLNPGFSENALSIQDGTEISGYFQSDKYYDNPDLVRQWFSLKEEKIASIRDRFSRLNFANSVGMHLRFGDVVGQLKRPPMRRSYYKKALSYIPNQELILVFSDEPERTKKMLDGLSGNFLFLSGHKNYEDLYLMTKCQHFICSYSTFSWWGAWLGGERERTVIYPKEGQYRPGYGRKAEGVSCESWIEVQSLRGFLDDYRLVSRLEKRLPKSLMNFFY

SEQ ID NO: 180 - protein, 281 aa, Bacteroides gallinarum
MRLIKMTGGLGNQMFIYAFYLRMKKRHTNTRIDLSDMMHYNVHHGYEMHHVFNLPKTEFCINQPLKKVIEFLFFKKIYERKQDSSNLLPFDKKYFWPLLYFKGFYQSERFFADMENDIRKAFTFNSGLFNEKTQTMLKQIEHNEHAVSLHVRRGDYLEPKHWKTTGSVCQLPYYINAIAEMNRRIEQPFYYVFSDDIAWVKENLPLPQAVFIDWNKGVESWQDMMLMSHCRHHIICNSTFSWWGAWLNPKENKTVIMPERWFQHCETPNIYPAGWIKVPIN

SEQ ID NO: 181 - protein, 268 aa, Firmicutes bacterium CAG:882
MNNVEIMGGLGKQLFQYAFSRYLQKLGVKNVVLRKDFFTIQFPENNGITKREFVLDKYNTRYVAAAGEKTYRDYCDENDYRDDYAIGSDEVLYEGYWQNIDFYNVVRKEMQEELKLKPEFIDNSMAAVEKDMSSCNSVALHIRRSDYLTQVNAQIFEQLTQDYYASAVSIIEQYTHEKPVLYIFSDDPEYAAENMKDFMGCRTVIMPPCEPYQDMYLMTRAKHNIIANSTFSWWGATLNANPDNITVAPSRWMKGRTVNLYHKDWITL

SEQ ID NO: 182 - protein, 301 aa, Bacteroides xylanisolvens
MIAVNVNAGLANQMFHYAFGRGLMAKGLDVCFDQSNFKPRSQWAFELVRLQDAFPSIDIKVMPEGHFKWVFPSLPRNGLERRFQEFMKKWHNFIGDEVYIDEPMYGYVPDMEKCATRNCIYKGFWQSEKYFRHCEDDIRKQFTFLPFDELKNIEVAAKMSQENSVAIHLRKGDDYMQSELMGKGLCTVDYYMKAIDYMRKHINNPHFYVFTDNPCWVKDNLPEFEYILVDWNEVSGKRNFRDMQLMSCAKHNIIGNSTYSWWAAWLNANQDKIVVGPKRFFNPINSFFSTCDIMCEDWISL

SEQ ID NO: 183 - protein, 281 aa, Geobacter sp. M18
MIGMVIFRAYNGLGNQMFQYALGRHLALLNEAELKIDTTAFADDPLREYELHRLKVQGSIATPDEIAFFREMENTHPQAYLRLTQKSRLFDPAILSARGNIYLHGFWQTEKYFADIREILLDEFEPIVPAGEDSIKVLSHMKATNAVALHVRRSDYVSNPMTLRHHGVLPLDYYREAVRRIAGMVPDPVFFIFSDDPQWAKDNIRLEYPAFCVDAHDASNGHEDLRLMRNCKHFIIANSSFSWWGAWLSQNTGKKVVAPLKWFAKPEIDTRDIVPLQWIRI

SEQ ID NO: 184 - protein, 281 aa, Ruegeria pomeroyi DSS-3
MITTRLHGRLGNQMFQYAAARGLAARLGTQVALDTRLAESRGEGVLTRVFDLDLAQPDQLPPLKGDGLLRHGAWRLLGLAPRFRREHGLGYNAAIETWDDGTYLHGYWQSERYFAHIAARIRADFAFPAFSNSQNAEMAARIGDTDAISLHVRRGDYVALAAHTLCDQRYYAAALTRLLEGVAGDPVVYLFSDDPAWARDNLALPVQKVVVDFNGPETDFEDMRLMSLCRHNIIGNSSFSWWAAWLNAHPGKRIAAPASWFGDAKLHNPDLLPPDWLKIEV

SEQ ID NO: 185 - protein, 299 aa, Lachnospiraceae bacterium 28-4
MIIIQLAGGLGNQMQQYAMYQKLLSLGKKVKLDISWFEEKNRQKNVYARRELELNYFKKAEYEACTEEERKALVGEGGFAGKIKGKLFPGTRKIFRETEMYHPEIFDFEDRYLYGYFACEKYYADIMEILQEQFVFPPSGNPENQKMAERIADGESVSLHIRRGDYLDAENMAMFGNICTEEYYAGAIREMKKIYPSAHFFVFSDDIPYAKETYSGEEFTVVDINRGKDSFFDIWLMSGCRHNICANSTFSFWGARLNRNKGKVVMRPFIHKNSQKFEPELMHELWKGWVFIDNRGNIC

SEQ ID NO: 186 - protein, 273 aa, Prevotella sp. CAG:1092
MRILVFTGGLGNQMFEYAFYKHLKSCFPKESFYGHYGVKLKEHYGLEINKWFDVTLPPAKWWTLPVVGLFYLYKKLVPNSKWLDLFQREWKHKDAKVFFPFKFTKQYFPKENGWLKWKVDEASLCEKNKKLLQVIHDEETCFVHVRRGDYLASNFKSIFEGCCTLDYYKRALEYMNKNNPKVRFICFSDDLEWMRKNLPMDDSAIYVDWNTGTDSPLDMYMMSQCDNGIIANSSFSYWGAYLGGKKTTVIYPQKWWNMEGGNPNIFMDEWLGM

SEQ ID NO: 187 - protein, 289 aa, Spirosoma luteum
MVISVLSGGLGNQLFQYAFGLKLAAQLQTELRLERHLLESKAIARLRQYTPRTYELDTFGVEAPAASLMDTVSCLSRVALSDKTALLLRESTLTPNAINNLNNRVRDVVCLGYWQSEEYFRPATEQLRKHLVFRKNPAQSRSMADTILSCQNAAFVHIRRGDYVTNTHANQHHGLCDVSYYRRACEYVKECIPDVQFFVFSDDPDWAKRELGIHLQPARFIDHNRGADSWQDMYLMSLCRHAIVANSSFSWWGAWLNPVAERLVVAPGQWFVNQPVLSQQIIPPHWHCL

SEQ ID NO: 188 - protein, 296 aa, Marinomonas posidonica
MIIVDLSGGLGNQMFQYACARSLSIELNLPLKVVYGSLASQTVHNGYELNRVFGLDLEFATENDMQKNLGFFLSKPILRKIFSKKPLNNLKFQNFFPENSFNYNSSLFSYIKDSGFLQGYWQTEKYFLNHKSQILKDFCFVNMDDETNISIANDIQSGHSISIHVRRGDYLTNLKAKAIHGHCSLDYYLKAIEFLQEKIGESRLFIFSDDPEWVSENIATRFSDVSVIQHNRGVKSFNDMRLMSMCDHHIIANSSFSWWGAWLNPSQNKKIIAPKNWFVTDKMNTIDLIPSSWILK

SEQ ID NO: 189 - protein, 263 aa, Bacteroides vulgatus
MKIVVFKGGLGNQLFQYAFYKYLSRKDETFYFYNDAWYNVSHNGFELDKYFKTDDLKKCSRFWIILFKTILSKLYHWKIYVVGSVEYQYPNHLFQAGYFLDKKYYDENTIDFKHLLLSEKNQSLLKDIQNSNSVGVHIRRGDYMTKQNLVIFGNICTQKYYHDAIRIITEKVNDAVFYVFSDDISWVQTHLDIPNAVYVNWNTGESSIYDMYLMSSCKYNIIANSTFSYWAARLNKKTNMVIYPSKWYNTFTPDIFPESWCGI

SEQ ID NO: 190 - protein, 285 aa, Candidatus Pelagibacter ubique
MTIRIKLTGGLGNQMFQFATGFAIAKKKNVRLSLDLKYINKRKLFNGFELQKIFNIYSKVSFLNKTLSFKSINFTEILNRIDTTFYNFKEPHFHYTSNILNLPKHSFLDGYWQSELYFNEFATEIKRIFNFSGKLDKSNLLVADDINRNNSISIHIRRGDFLLKQNNNHHTDLKEYYLKAINETSKIFKNPKYFIFSDDTSWTVDNFVIDHPYIIVDINFGARSFLDMYLMSLCKSNIIANSSFSWWSAWLNNNKDKIIYAPKNWFNDKSICTDDLIPESWNIIL

SEQ ID NO: 191 - protein, 289 aa, Bacteroides sp. CAG:875
MSVIINMACGLANRMFQYAFYLYLQKEGYDAYVDYFTRADLVHENVDWLRIFPEATFRRATARDIRKMGGGHDCFSRLRRKLLPMTTKVLETSGAFEIILPPKNRDSYLLGAFQSAKMVESVDAEVRRIFTFPEFESGKNQYFQTRLAQENSVGLHIRKGKDYQERIWYKNTCGVEYYRKAVDLMKEKVDSPSFYVFTDNPAWVKENLSWLEYKLVDGNPGSGWGSHCDMQLMSLCKHNIISNSSYSWWGAYLNNTLNKIVVCPRIWFNPESTKDFSSNPLLAEGWISL

SEQ ID NO: 192 - protein, 309 aa, Butyrivibrio fibrisolvens
MIIIKLQGGLGNQLFLYGLYKNLKHLKRDVKMDIESGFEGDELRKPCLDCMNLEYAIATRDEVTDIRDSYMDIFSRIRRKITGRKTFDYYEPEDGNYDPKVLEMTKAYLNGYFQSEKYFGDEESVKALKDELTKGKEDILTSTDLITKIYHDIKNSESVSLHIRRGDYLTPGIIETYGGICTDEYYDKAIAMIRETFPEARFFIFSNDIEWCKEKFAGDKNILFVNTIGINLDSEDNIKIGKSDKDISEYRDLAELYLMSACKHHILANSSFSWWGAWLSDHEGMTIAPSKWLNNKNMTDIYTKDMLLI

SEQ ID NO: 193 - protein, 282 aa, Roseburia hominis
MVTVKIGDGMGNQMYNYACGYAAAKRSGEKLRLDISECDNSTLRDYELDHFRVVYDEKESFPNRTFWQKLYKRLRRDIRYHVIRERDMYAVDARVFVPARRGRYLHGYWQCLGYFEEYLDDLREMFTPAYEQTDAVRELMQQFTQTPTCALHVRGGDLGGPNRAYFQQAIARMQKEKPDVTFIVFTNDLPKAKECLDDGEARMRYIAEFGEALSDIDEFFLMSACQNQIISNSTYSTWAAYLNTLPGRIVIVPKFHGVEQMALPDWIVLDGGACQKGEIDAV

SEQ ID NO: 194 - protein, 316 aa, Rhodopirellula europaea
MATSVHPHLSDGKQALDSKAAQQVCSTQAASASDRACTISISGGLGNQMLQYAAGRALSIHHDCPLQLDLKFYSSKRHRSYELDAFPIQAQRWIKPSFFSQVLDKIQGESKSAPTYEEQSKRFDRAFFDIELPARIRGYFFSEKYFLPYADQIRTELTPPVPLDQPARDMAQRLSEGMSTSLHVRRGDYVSNANARQRFWSCTSEYFEAAIEQMPADSTVFVFSDDIEWAKQNIRSSRPTVYVNDELKLAGSPETGLRDLWLMTHAKSHIIANSSFSWWGAWLSGSEANLTIAPKKWFNDPEIDDSDIVPTSWRRI

SEQ ID NO: 195 - protein, 289 aa, Rudanella lutea
MVIAKITSGLGNQLFQYALGRHLAIQNQTRLWFDLRYYHRTYETDTPRQFKLDRFSIDYDLLDYSPWLYVSKATRLLPGRSLRPLFDTRKEPHFHLDPAVPNAKGAFITLDGFWQSEGYFASNAATIRRELTFTRQPGPMYARYRQQIEQTQTPVSVHIRRGDYVSHPEFSQSFGALDDTYYQTALAQINGQFPDATLLVFSDDPEWVRQHMRFERPHVLVENTGPDADVDDLQLMSLCHHHIIANSSFSWWGAWLNPRPDKRVIAPKQWFRNKPWNTADLIPAGWVRL

SEQ ID NO: 196 - protein, 280 aa, Paraprevotella clara YIT 11840
MRLIKMTGGLGNQMFIYAMYLKMKTIFPDVRIDLSDMVHYQVHYGYEMNKVFHLPRTEFCINRSLKKIIEFLLFKTILERKQGGSLVPYTRKYHWPWIYFKGFYQSEKYFAGIEKEVREAFVFDIRRASRRSLRAMQEIKADPHAVSIHVRRGDYLLEKHWKALGCICQSSYYLNALAELEKRVKHPHYYVFSEDLNWVRQNLPLIKAEFIDWNKGEDSWQDMMLMSHCRHHIICNSTFSWWGAWLNPLPDKIVIAPERWTQTTDSADVVPESWLKVSIG

SEQ ID NO: 197 - protein, 288 aa, Smaragdicoccus niigatensis
MADVVVTLAGGLGNQLFQTAYAKNLEARGHRVTLDGTVVRWTRGLHIDPQICGLKILNATPPAPVPGRLAATVLRRALATRLRFGPDGRIVRTQRTLEFDEQYLNLNSPGRYRVEGYWQCERYFSDVGQTVRKVFLDMLGRHVSYNGLSRLPAMADPSSISLHVRRGDYVTANFIDPLALEYYERALEELAVPSPRIFVFSDDLDWATRELGRICDVIPVEPDWTSHPGGEIFLMSQCSHHIIANSSFSWWGAWLDGRTSSRVVAPRQWFSLETYSARDIVPDRWTKV

SEQ ID NO: 198 - protein, 304 aa, Bacteroides fragilis CAG:558
MIHLILGGGLGNQMFQYAFARSLALQYNENISFNTILYKELKNEERSFSLGHLNINTMCIVETPDENKRIWELFNKQIFHQKIARKILPASIRWWWMSNRNIYANVCGPYKYYHPRHRSQNTTIIHGGFQSWKYFKEHQSMIKAELKVITPISEPNKKILKEIQNSNSICVHIRRGDFLSAQFSPHLEVCNKDYYEKAIKMISSQIENPTFFIFSNTHEDLVWIRKNYNIPQNSVYVDLNNPDYEELRLMYNCKHFILSNSSFSWWAQYLSESKNKIIIAPKIWDKRKGIDFSDIYMPEWIIIK

SEQ ID NO: 199 - protein, 295 aa, Desulfovibrio desulfuricans
MSFSIDVAAIQRMALVKVDGGLGSQMWQYALSLAVGKSSSFTVKHDLSWFRHYAKDIRGIENRFFILNSVFTNINLRLASENERLFFHIALNRYPDSICNFDPDILALKQPTYLGGYYVNAQYVTSAEKEIREAYVFAPAVEESNQAMLQTIHAAPMPVAVHVRRGDYIGSMHEVLTPRYFERAFKILAAALQPKPTFFVFSNGMEWTKKAFAGLPYDFVYVDANDNDNVAGDLFLMTQCKHFTISNSSLSWWGAWLSQRAENKTVIMPSKWRGGKSPIPGECMRVEGWHMCPVE

SEQ ID NO: 200 - protein, 282 aa, Hoeflea phototrophica
MHGGLGNQLFQYAVGRAVALRTGSELLLDTREFTSSNPFQYDLGHFSIQAKVANSSELPPGKNRPLAYAWWRKFGRSPRFVREQDLGYNARIETIEADCYLHGYFQSQKYFEDIASILWKDLSFRQAISGENASMAERIQSAPSVSMHIRRGDYLTSAKARSTHGAPDLGYYGRALGEIRARSGSDPVVYLFSDDPDWVRNNMRMDANLVTVAINDGKTAFEDLRLMSLCDHNIIVNSTFSWWGAWLNPSLDKIVVAPKRWFADPKLSNPDITPPGWLRLGD

SEQ ID NO: 201 - protein, 286 aa, Vibrio cholerae
MKIISFSGGLGNQLFQYAFYLYLKDNSDFGNIFLDFSFYESQNKRDAVIRNFYGVDSLDIIKQSSYVRGKFLILKLINKFRFFNNLLEFVDKENGLDETLLSTNKVFFDGYWQSYRYVKDYKSNIKELFSFYDFKGNILEVRKKICQSNSVCMHVRRGDYVAEKNTKLVHGVCSLQYYRDALNNIKNVDNSIDHIFIFSDDIDWVKNNISFDIPVTVVDFVGQSVPDYAEMLLFSCGKHKVIANSTFSWWGAFLSDRNGVIVSPKKWFAKEEKNYDEIFIEGSLRL

SEQ ID NO: 202 - protein, 295 aa, Lachnospiraceae bacterium NK4A179
MIIVRFRGGMGNQMFQYAFLRYLEMKGATLKADLSEFKCMKTHAGYELDKAFDLHPAEASYKEIRAVADYIPVMHRFPFSRKVFEILYKKETKRVEAEGPKKSHISEEKYFDMSEDERLHLASSSEDLYMDGFWIKPDMYDDEVLKCFTFSKTLDEKYKGTIEDEHSCSVHVRCGDYTGTGLDILGKEYYEKAAEKILSEDADVKFYVFSDDREKAEKLLSPFMKKMVFCDTPASHAYDDMYLMSRCRHHIIANSTFSFWGARLSADKSGITICPKYEDKNNTANRLVHEGWQML

SEQ ID NO: 203 - protein, 289 aa, Cecembia lonarensis
MIIMKFMGGLGNQIYQYALGRKLSELHNSFLASDIHIYKNDPDREFVLDKFNIKVKHLPWKVIKLLNSDYALKFDKVFHTEFYHELVLEKALESKDIPRKNNLYLRGSWGNRKYYEDYIDKISDEITLKEKFKTKDFNTVNKKVKNSDSVGIHIRRGDYEKVAHFKNFYGLLPPSYYSAAVDFIGNRIEKSNFFIFSDDTDWVKENLPFLKDSFFVSDIIGSVDYLEFELLKNCKHQIIANSTFSWWAARLNSNPAKIVIKPKRWFADDRQQAVYEIEDSYYIKEAIKL

SEQ ID NO: 204 - protein, 292 aa, Bacteroides ovatus
MKIVNILGGLGNQMFVYAMYLALKEAHPEEEILLCRRSYKGYPLHNGYELERIFGVEAPEAALSQLARVAYPFFNYKSWQLMRHFLPLRKSMASGTTQIPFDYSEVTRNDNVYYDGYWQNEKNFLSIRDKVIKAFTFPEFRDEKNKALSDKLKSVKTASCHIRRGDYLKDPIYGVCNSDYYTRAITELNQSVNPDMYCIFSDDIGWCKENFKFLIGDKEVVFVDWNKGQESFYDMQLMSLCHYNIIANSSFSWWGAWLNNNDDKVVVAPERWMNKTLENDPICDNWKRIKVE

SEQ ID NO: 205 - protein, 281 aa, Bacteroides coprocola CAG:162
MRLIKMTGGLGNQMFIYAFYLKMKKLFPHTKIDLSDMMHYHVHHGYEMNRVFALPHTEFCINRTLKKLMEFLLCKVVYERKQKNGSMEAFEKKYAWPLIYFKGFYQSERFFADIEDDVRKTFCFNMELINSRSREMMKIIDADEHAVSIHIRRGDYLLPKFWANAGCVCQLPYYKNAITELEKHESTPSFYVFSDDIEWVKQNLSLPNAHYIDWNQGNDSWQDMMLMSHCRNHIICNSTFSWWGAWLNPRKNKTVIVPSRWFMKEETPYIYPVSWIKVPIN

SEQ ID NO: 206 - protein, 281 aa, Bacteroides dorei
MRLIKVTGGLGNQMFIYAFYLRMKKYYPKVRIDLSDMMHYKVHYGYEMHRVFKLPHTEFCINQPLKKIIEFLFFKKIYERKQAPNSLRAFEKKYFWPLLYFKGFYQSERFFADIKDEVREAFTFDRSKANSRSLDMLDILDKDENAVSLHIRRGDYLQPKHWATTGSVCQLPYYQNAIAEMSKRVTSPSYYIFSDDIVWVRENLPLQNAVYIDWNTGEDSWQDMMLMSHCKHHIICNSTFSWWGAWLNPSIDKTVIVPSRWFQYSETPDIYPTGWIKVPVD

SEQ ID NO: 207 - protein, 276 aa, Bacteroides intestinalis CAG:564
MIIVRLWGGLGNQLFQYSFGQYLEIETDKKVFYDVASFGTSDQLRKLELCSFIPDIPLYNAYFTRYTGVKNRLFKALFQWSNTYLSESMFDICLLEKARGKIFLQGYWQEEKYATYFPMQKVLSEWKNPNVLSEIEENIRSAKISVSLHVRRGDYFSPKNINVYGVCTEKYYEQAIDRANSEIEEDKQFFVFSDDILWVKNHVSLPESTVFVPNHEISQFAYIYLMSLCKVNIISNSTFSWWGAYLNQHKNQLVIAPSRWTFTSNKTLALDSWTKI

SEQ ID NO: 208 - protein, 297 aa, Lachnospiraceae bacterium A4
MIVIHVMGGLGNQLYQYALYEKLRALGREVKLDVYAYRQAEGAEREWRALELEWLEGIRYEVCTAAERQQLLDNSMRLADRVRRRLTGRRDKTVRECAAYMPEIFEMDDVYLYGFWGCEKYYEDIIPLLQEKIVFPESSNPKNADVLRAMAGENAVSVHIRRKDYLTVADGKRYMGICTDAYYKGAFRYITERVERPVFYIFSDDPAFAKTQFCEENMHVVDWNTGRESLQDMALMSRCRHNICANSTFSIWGARLNRHPDKIMIRPLHHDNYEALDARTVHEYWKGWVLIDADGKV

SEQ ID NO: 209 - protein, 285 aa, Phaeobacter gallaeciensis
MIITRLHGRLGNQMFQYAAGRALADRLGVSVALDSRGAELRGEGVLTRVFDLDLATPDILPPLRQRAPLGYALWRGLGQHLGTGPKLRREVGLGYNPDFVDWSDNSYLHGYWQSERYFAQSAERIRRDFTFPEYSNQQNAEMAARIGETNAISLHVRRGDYLTLAAHVLCDQAYYEAALAQVLDGLEGQPTVYVFSDDPQWAKENLPLPCDKVVVDFNGADTDYEDMRLMSLCKHNIIGNSSFSWWAAWLNQTPDRRVAGPTKWFGDPKLNNPDILPPDWLRISV

SEQ ID NO: 210 - protein, 686 aa, Firmicutes bacterium CAG:791
MSGGLGNQMFQYALYLKLRSLGREVCFDDKSQYDEETFRNSSQKRRPKHLDIFGITYPSAGKEELEKLTDGAMDLPSRIRRKILGRKSLEKNDRDFMFDPSFLEETEGYFCGGFQSPRYFAGAEEEVRKAFTFPEELLCPKEGCSRQEQKMLEQSASYAERIRKANCEAADRGVPGGGSASIHLRFGDYVDKGDIYGGICTDAYYDTAIRCLKERDPGMIFFVFSNDEEKAGEWIRYQAERSENLGRGHFVLVKGCDEDHGYLDLYLMTLCRNHVIANSSFSWWASFMCDAPDKMVFAPSIWNNQKDGSELARTDIYADFMQRISPRGTRLSDRPLISVIVTAYNVAPYIGRALDSVCGQTWKNLEIIAVDDGSSDETGAILDRYAAGDSRIQVVHTENRGVSAARNEGIAHARGEYIGFVDGDDRAHPAMYEAMIRGILSSGADMAVVRYREVSAEETLTDAEEQVASFDPVLRASVLLQQRDAVQCFIRAGMAEEEGKIVLRSAVWNKLFHRRLLRDNRFPEGTSAEDIPFTTRALCLSKKVLCVPEILYDYVVNRQESIMNTGRAERTLTQEIPAWRTHLELLKESGLSDLAEESEYWFYRRMLSYEEEYRRCSETAKEAKELQERILKHRDRILELAEEHSFGRRGDRERLKLYVNSPRQYFLLSDLYEKTVVNWKNRPDKT

SEQ ID NO: 211 - protein, 290 aa, Butyrivibrio proteoclasticus
MRKRIIALNGGLGNQMFQYAFARMLEDRKHCLIEFDTGFYSTVNDRKLAIQNYNIHKYDFCNHEYYNKIRLLFQKIPFVAWLAGTYKEYSEYQLDPRVFLFNYRFYYGYWQNKQYFENISNDIRNELSYIGNVSEKENALLNMLEAHNAIAIHVRRGDYTQEGYNKIYISLSKEYYKRAVSIACKELGDNNIPLYVFSDDIDWCKANLADIGNVTFVDNTISSSADIDMLMMKKSRCLITANSTFSWWSAWLSDRDDKIVLVPDKWLQDEEKNTKLMKAFICDKWKIVPV

SEQ ID NO: 212 - protein, 286 aa, Bacteroides sp. 2_1_16
MQVVARIIGGLGNQMFIYATARALALRIDADLILDTQSGYKNDLFKRNFLLDSFCISYRKANCFQKYDYYLGEKVKSLGKKTHFSVIPFMKYISENTSCDFVDGLLKKHILSVYLDGYWQNEAYFKDYASIIKKDFQFCQVNDLRTLSEAEIIKKSITPVAIGVRRYQELNSHQNTKVTDLDFYQKAINYIESKVDNPTFFIFSEDQEWVKNNLEQKSNFIMISPKEGNYSALNDMYLISLCKHHIVSNSSFYWWGAWLANNKNKIVVASDCFLNPQSIPDSWIKF

SEQ ID NO: 213 - protein, 300 aa, Desulfomicrobium baculatum
MAKIVTRIMGGIGNQLFCYAAARRLALVNHAELVIDDVTGFSRDRVYRRRYMLDHFNISARKATNYERMEPFERYRRGLAKYISKKLPFFEREYIEQERIEFDPRFLEYRTYNNIYIDGLWQSENYFKDVEDIIRDDLKIIPPTDLENINIAKKIKNIQNTIAMHVRWFDLPGINLGNNVSTYYYHRAIAMMEQRINAPHYFLFSDNLEAVHSKLDLPEGRVTFVSNNDGDDNAYADLWLMSQCKHFITANSTFSWWGAWLGESRDSVVLVPRFSPDGGVTSWCFTGLIPERWEQVSSIR

SEQ ID NO: 214 - protein, 287 aa, Prevotella pleuritidis
MDIVLIFNGLGNQMSQYAFYLAKRQRNNHTVYCVFGPRTQYSLDKLFDIPYRHNAVLVLLYRALDKAHFSNHRWLRRLLRPTLQLLGVKMIVEPLSRDFDMRHFTHQKGIVFYRGGWHSELNFTAVADAVKRRFRFPEIQDAAVLAVIDRIKSCQSVSLHLRRGDYLGLSEFQGVCTEAYYEHAIAYFESQIESPEYFVFSDDPTYAREQFGADPNFHIIDLNHGEDAWCDLLMMTQCRYNIIANSTFSWWGAWLNDNPSKIVVHPRYHLNGVETRDFYPRNWICIE

SEQ ID NO: 215 - protein, 277 aa, Bacteroides sp. 1_1_14
MKVIWFNGNLGNQVFYCKYKEFLHNKYPNETIKYYSNSRSPKICVEQYFRLSLPDRIDSFKVRFVFEFLGKFFRRIPLKFVPKWYCTRKSLNYEASYFEHYLQDKSFFEKEDSSWLKAKKPDNFSEKYLIFENLICNTNSVAVHIRRGDYIKPGSDYEDLSATDYYEQAIKKATEVYLDSQFFFFSDDLEFVKNNFKGDNIYYVDCNRGADSYLDILLMSQAKINIIANSTFSYWGAYMNHEKKKVMYSDLWFRNESGRQMPNIMLDSWICIETKRK

SEQ ID NO: 216 - protein, 314 aa, Agromyces subbeticus
MVGRVGIARRQAADVSCTDGEGLVAWRIRTGEIVLGLQGGIGNQLFEWAFAMALRSIGRRVLFDAVRCRGDRPLMIGPLLPASDWLAAPVGLALAGATKAGLLSDRSWPRLVRQRRSGYDPSVLERLGGTSYLLGTFQSARYFDGVEHEVRAAVRALLEGMLTPSGRRFADELRADPHRVAVHVRRGDYVSDPNAAVRHGVLGAGYYDQALEHAAALGHVRRVWFSDDLDWVREHLARDDDLLCPADATRHDGGEIALIASCATRIIANSSFSWWGGWLGAPSSPAHPVIAPSTWFADGHSDAAELVPRDWVRL

SEQ ID NO: 217 - protein, 291 aa, Prevotella salivae
MIATTLFGGLGNQMFIYATAKALSLHYRTPMAFNLRQGFEQDYKYQRHLELNHFKCQLPTAKWITFNYKGELNIKRISRRIGRNLLCPHYQFIKEKEPFHYEKRLFEFTNKNIFLEGYWQSPRYFENYSDEIRRDFQLKSILPHTITDELQMLKGTGKPLVMLGIRRYQEVKDKKDSPYPLCNKDYYAKAISHVQEQLPAPLFVVFTQEQAWAMNNLPTNANLYFVKEKDNAWATIADMYLMTQCQHAIISNSTFYWWGAWLQHPIENHIVVAPNNFINRDCVCDNWIILD

SEQ ID NO: 218 - protein, 304 aa, Carnobacterium sp. WN1359
MIFVDLSEGLGNQMFQYAYSRYLQELYGGTLYLNTSSFKRKNSTRSYSLNNFYLYENVKLPSKFRRVIYNFYSKTIRMFIKKVIRMNPYSDKYYFSMIPYGFYVSSQVFKYLTVPTTKRHNIFVMGTWQTNKYFQSINDKIKDELKVKTEPNELNKKLITEINSNQSVCVHIRLGDYTNPEFDYLHVCTSDYYLKGMDYIVSKVKEPNFYIFSNSSSDIEWIKNNYNFKYKVKYIDLNNPDFEDFRLMYNCKHFIISNSTFSWWAQFLSNNDKKIIVAPSKWQKSNENEAKDIYLDHWKLIEIE

SEQ ID NO: 219 - protein, 304 aa, Butyrivibrio sp. AD3002
MLIIQIAGGLGNQMQQYAMYRKLLKAGADRNIKLDTKWFDEDKQSGVLAKRKLELEYFTGLPLPVCSESERARFTDRSVARKVVEKLVPGMGSRFTESCMYHPEIFELKDKYIEGYFACQKYYDDIMGELQELFVFPTHPDEEINIKNMNLMNEMEMVPSVSVHIRRGDYLDPENAALFGNIATDAYYDSAMEYFKAIDPDTHFYIFTNDPEYAREKYADPGRYTIVDHNTGKYSLLDIQLMSHCRGNICANSTFSFWGARLNRRKDKIPVRTLVMRNNQPVTPELMHEYWPGWVLVDKDGKVR

SEQ ID NO: 220 - protein, 299 aa, Clostridium sp. KLE 1755
MIVIRVMGGLGNQMQQYALYEKFKALGKETRLDTSWFDNASMQENVLARRSLELRFFDNLTYEACTPQEREALLGKEGFFNKLERKLFPSKNKHFYESEMFHPEIFKLDNVYLEGHWACEKYYHDIMPLLQSKIIFPKTDNIQNNMLKNKMNSENSVSIHIRRGDYLDPENAAMFGGICTDSYYKSAEGYIRNRVTNPHFYLFSDDPAYLREHYKGEEYTVVDWNHGADSFYDMELMSCCKHNVCANSTFSFWGARLNRTEKKIVIRPAKHKNSQQAEPERMHELWENWVIIDEEGRIV

SEQ ID NO: 221 - protein, 275 aa, Bacteroides vulgatus
MKFFVFGGGLGNQLFQYSYYRYLKKKYPSERILGIYPDSLKAHNGIEIDKWFDIELPPTSYLYNKLGILLYRVNRFLYNHGYRLLFCNRVYPQSMKHFFQWGDWQDYSIIKQINIFEFRSELPIGKENMEFLKKMETCNSISVHIRRGDYLKTDLIHIYGGICTSKYYREAIKFMEQEVEEPFFFFFSDDCLYVETEFADIRNKIIISHNRDDRSFFDMYLMAHAKNMILANSTFSCWAAYLNRTAKIIITPDRWVNTDFSKLEALPNEWIKIRV

SEQ ID NO: 222 - protein, 280 aa, Paraprevotella xylaniphila
MRLIKMTGGLGNQMFIYAMYLKMRAVFPDTRIDLSDMVHYRVHYGYEMNKVFNLPRTEFRINRSLKKIIEFLLFKTILERKQGGSLVPYIRKYHWPWIYFKGFYQSEEYFAGVEKEVREAFVFDVRRVNRKSLCAMQEIMADPDAVSIHVRRGDYLQGKHWKSLGCICQRSYYLNALSELEKRIVHPHYYVFSEDLDWVRQYLPLENAVFIDWNKGEDSWQDMMLMSHCRHHIICNSTFSWWGAWLNPSPDKIVIAPERWTQTTNSADVVPESWLKVSIG

SEQ ID NO: 223 - protein, 290 aa, Thauera sp. 28
MTDRALIAIVKGGLGNQLFIYAAARAMALRTGRQLYLDAVRGYLADDYGRSFRLNRFPIEAELMPEQWRVASTLRHPRAKLVRALNKYLPEAWRFYVAERGDTRPGALWNHGRNVKRVTLMGYWQDEAYFLDYAELLRRELGPPMPDAPEVRARGERFAGTESVFLHVRRCRYSPLLDAGYYQKAVDLACAELNKPVFMIFGDDIEWVVNNIDFRGAGYERQDYDESDELADLWLMTRCRHAIIANSSFSWWAAWLGGAAGSGRHVWAPGQSGLALKCAKSWEAVDAQPE

SEQ ID NO: 224 - protein, 305 aa, Subdoligranulum variabile
MIYAELAGGLGNQMFIYAFARALGLRCGEAVTLLDRQDWRDGAPAHTACALEGLNLVPEVKILAEPGFAKRHLPRQNTAKALMIKYEQRQGLMARDWHDWERRCAPVLNLLGLHFATDGYTPVRRGPARDFLAWGYFQSEAYFADFAPTIRAELRAKQAPAGVWAEKIRAAACPVALHLRRGDYCRPENEILQVCSPAYYARAAAAAAAAYPEATLFVFSDDIDWAKEHLDTAGLPAVWMPRGDAVGDLNLMALCRGFILSNSTYSWWAQYLAGEGRTVWAPDRWFAHTKQTALYQPGWHLIETR

SEQ ID NO: 225 - protein, 308 aa, Firmicutes bacterium CAG:24
MIIVEVMGGLGNQMQQYALYRKLESLGKDARLDVSWFLDKERQTKVLASRKLELSWFENLPAKYCTQEEKQAILGKNNLIGKLKKKLLGGSNRHFTESDMYHPEIFDLEDAYLSGFWACEAYYADILPMLRSQIHFPDPEKGEGWDLEAAAKNKETMERMKQETSVSIHIRRGDYLDAKNAEMFGGICTDAYYEAAISYIKEQTPDAHFYVFSDDSAYVKNAYPGKEFTVVDWNTGKNSLFDMQLMSCCNHNICANSTFSFWGARLNPSPDKVMIRPSKHKNSQNIVPEEMKRLWDGWVLIDGKGRII

SEQ ID NO: 226 - protein, 283 aa, Prevotella sp. CAG:474
MIITKLNGGLGNQLFEYACARNLQLKYNDVLYLDIEGFKRSPRHYSLEKFKLSSDVRMLPEKDSKSLILLQAISKLNRNLAFKLGPLFGTYIWKSSNYRPLKIKNTRGKKLYLYGYWQSYEYFKENEAIIKQELNVKTEIPIECSELLKEINKPHSICVHVRRGDYVSCGFLHCDEAYYNRGINHIFDKHPDSNVVVFSDDIKWVKANMNFDHPVAYVEVDVPDYETLRLMYMCKHFVMSNSSFSWWASYLSDNKEKIVVAPSYWLPANKDNKSMYLDNWTIL

SEQ ID NO: 227 - protein, 298 aa, Roseburia intestinalis
MRGNRGMIAVKIGDGMGNQLFNYACGYAQARRDGDSLVLDISECDNSTLRDFELDKFHLKYDKKESFPNRNLGQKIYKNLRRALKYHVIKEREVYHNRDHRYDVNDIDPRVYKKKGLRNKYLYGYWQHLAYFEDYLDEITAMMTPAYEQSETVKKLQEEFKKTPTCAVHVRGGDIMGPAGAYFKHAMERMEQEKPGVRYIVFTNDMERAEEALAPVLESQKKDAVGQAENRLEFVSEMGEFSDVDEFFLMAACQNQILSNSTFSTWAAYLNQNPDKTVIMPDDLLSERMRQKNWIILK

SEQ ID NO: 228 - protein, 265 aa, Bacteroides ovatus
MKIVLFTPGLGNQMFQYLFYLYLRDNYPNQNIYGYYNRNILNKHNGLEVDKVFDIQLPPHTVISDASAFFIRALGGLGLKYFIGKDQLSPWKVYFDGYWQNKEYFQNNVDKMRFREGFLNKKNDDILSLIRNTNSVSVHVRRGDYCDSCRKDLFLQSCTPQYYESAISVMKEKFQKPVFFVFSDDIPWVKVNLNIPNAYYIDWNKKENSYLDMYLMSLCTASIIANSTFSFWGAMLGNKKELVIKPKKWIGDEIPEIFPPSWLSL

SEQ ID NO: 229 - protein, 310 aa, Butyrivibrio sp. AE3009
MLIIQIAGGLGNQMQQYALYRKLLKYHPDGVRLDLSWFDSEVQKNMLAKREFELALFKGLPYIECKPEERAAFLDRNAAQKLSGKVLKKLGLRDNANPNVFEESRMFHPEIFELDNKYIIGYFACQKYYDDIMGDLCNLFEFPEHLDPELEKKNLELISKMEKENSVSVHIRRGDYLDPENFKILGNIATDEYYESAMKYFEDRYEKVHFYIFTSDHEYAREHFADESKYTIVDWNTGKDSLQDVRLMNHCLGNICANSTFSFWGARLNQRQDKVMIRTYKMRNNQPVDPDTMHDYWKGWILIDETGREV

SEQ ID NO: 230 - protein, 300 aa, Butyrivibrio proteoclasticus
MTKNEKKLIVKFQGGLGNQLYEYAFCEWLRQQYSDYEVLADLSYYKIRSAHGELGIWNIFPNINIEVASNWDIIKYSDQIPIMYGGKGADRLNSVRTNVNDRFFSKRKHSYYTEISNTDVSEVINALNNGIRYFDGYWQNIDYFKGNIEDLRNKLKFSEKCDKYITDEMLRDNAVSLHVRRGDYVGSEYEKEVGLSYYKKAVEYVLDRVDQAKFFIFSDDKYYAETAFEWIDNKTVVAGYDNELAHVDMLLMSRMKNNIIANSTFSLWAAYLNDSMNPLIVYPDVESLDKKTFSDWNGIK

SEQ ID NO: 231 - protein, 292 aa, Prevotella nanceiensis
MDSQFLKHIKLSGGFGNQLFQYFFGEYLKEKYNCSISFFSEPALDINQLQIHRFFPALRISHNTELRPYHYSFTQQLAYRCMRKLLLLFPFLNRKVKIENGSNYQNQSFNDTYCFDGYWQSYRYLSAFTPSLQFEDQLINDISADYINAIEQSEAVFLHIRRGDYLNKENQKVFAECPLNYFENAANRIKEDIKNVHFFVFSNDIQWVKSHLKLNDNEVTFIQNEGNSCDLKDFYLMTRCKHAIISNSTFSWWAAYLINNSDKKVIAPKHWYNDISMNNATKDLIPPTWIRL

SEQ ID NO: 232 - protein, 285 aa, Bacteroides ovatus
MIITRLHGRLGNQMFQYAAGRALADRAGVPLALDSRGAILRGEGVLTRVFDLELADPVHLPPLKQTNPLRYAIWRGIGQKVGAKPYFRRERGLGYNPAFEDWGDNSYLHGYWQSQKYFQNSAERIRSDFTFPAFSNQQNAEMAARIAESTAISLHVRRGDYLTFAAHVLCDQAYYDAALAKVLDGLQGDPIVYVFSDDPQWAKDNLSLPCEKVVVDFNGPETDFEDMRLMSLCQHNIIGNSSFSWWAAWLNQTPGRRVAGPAKWFGDPKLSNPDIFPHDWLRISV

SEQ ID NO: 233 - protein, 283 aa, Winogradskyella psychrotolerans
MGNQLYEYATAKAMAVALNKKLVIDPRPILKEAPQRHYDLGLFNIQDEDFGSPFVQWLVRWVASVRLGKFFKTIMPFAWSYQMIRDKEEGFDESLLQQKSRNIVIEGYWQSFKYFESIRPTLLKELSFKDKPNAINQKYLDEIESVNAVAVHIRRGDYVANPVANAVHGLCDMDYYKKAIAIIKDKVENPYFFIFTDDPDWAEDNFKISEHQKIIKHNIGKQDHEDFRLLTNCKYFIIANSSFSWWGAWLSDYKNKIVISPNKWFNVDAVPITERIPESWIRV

SEQ ID NO: 234 - protein, 302 aa, Lachnospiraceae bacterium NK4A179
MITVRIDGGFGNQMFQYAFFLHLKKTITDNKISVDLNCYNPHGSGDIFTRFKLAPEQAAPSEIKRFHRNSIYHLLRPLDSAGITTNPYYREEDIDDLNSVLNKKRVYLRGYWQDKRYPFSVKDQLIDCFDLGKMDMTGASAENNVILEQIASEESRSVGVHLRGGDYIGDPVYSGICTPEYYEAAFKHVSEKIKDPVFHIFTNDISMIEKCGLSGKYDLKITDINDEAHGWADLKLMSACRHHIISNSSFSWWAAFLGEATTEASADVINVIPEYMRQGVSAETLRCPCWTTVTSDGRVYPS

SEQ ID NO: 235 - protein, 263 aa, Prevotella sp. oral taxon 317
MKIVCIKGGLGNQLFEYCRYRSLHRHDNRGVYLHYDRRRTKQHGGVWLDKAFHITLPNEPLRVKLLVMVLKTLRRLHLFKRLYREEDPRAVLIDDYSQHKQYITNAAEILNFRPFEQLDYAEEIQTTPFAVSVHVRRGDYLLLANKSNFGVCSVHYYLSAAVAVRERHPESRFFVFSDDMEWAKENLNLPNCVFVEHAQAQPDHADLYLMSLCKGHIIANSTFSFWGAYLSKGSSAIAIYPKQWFAEPTWNVPDIFPAHWMAL

SEQ ID NO: 236 - protein, 309 aa, Butyrivibrio sp. XPD2006
MLIIQIAGGLGNQMQQYAVYTKLRGMGKDVRLDLSWFDPSVQKNMLAPREFELSMFEGVDYTECTAEERDSFLKQGMIANVTGKMLKKLGLRDEANPKVFSEKEMYHPEIFELEDRYIKGYFACQKYYDDIMGELWEKYTFPAHSDPDLHTRNMALVERMEKETSVSVHIRRGDYLDPSNVEILGNIATEEYYQGAMDYFSVKDPDTHFYIFTSDHEYAREKFSDESKYTIVDWNSGRNSVQDLMLMSHCKGNICANSTFSFWGARLNRRPDKTVIRTYKMRNNQPVNPDIMHDYWKGWILMDEKGSII

SEQ ID NO: 237 - protein, 317 aa, Butyrivibrio fibrisolvens
MIIIKLQGGLGNQLFLYGLYKNLKHLKRDVKMDIESGFEEDKLRVPCLKSMGLDYEVATRDEIVAIRDSYMDIFSRIRRKITGRKTFDYYEPEDGNFDPRVLEQTHAYLDGYFQSEKYFGDSDDRKKLKDELLKEKIRVLDSSDTLKDLYNMMSSGSSVSLHIRRGDYLTPGIMETYGGICTDEYYDIAMNRIKNEYPDSKFFIFSNDIDWCKEKYGSRDDVIFVDSCDEHEGLTNVSGDQDDIQVQGDIKEHGNNSLRDAAELYLMSACKHHILANSSFSWWGAWLSDHEGMTIAPSKWLNNKNMTDIYTKDMLLI

SEQ ID NO: 238 - protein, 297 aa, Cylindrospermopsis raciborskii
MKKTVVLLKGGLGNQMFQYAFARSISLKNSSKLVIDNWSGFTFDYKYHRQYELGTFSIVGRPANLTEKFPFWFYELKSKFFPRLPKVFQQQFYGLLINEVGGEYIPEIEETKISQNCWLNGYWQSPLYFQKHSDSITRELMPPEPMEKHFLELGKLLRETESVALGIRLYEESKNPGSHSSSGELKSHFEINQAILKLRELCNGAKFFVFCTHRSPLLQELALPENTIFVTHDDGYVGSMERMWLLTQCKHHIFTNSTFYWWGAWLSQKFYIQGSQIVFAADNFINSDAIPKHWKPF

SEQ ID NO: 239 - protein, 273 aa, Prevotella multiformis
MKIVNFQGGLGNQMFIYAFSRYLSRLYPQEKIYGSYWSRSLYVHSAFQLDRIFSLQLPPHNLFTDCISKLARFFERLRLVPVEETPGSMFYNGYWLDKKYWEGIDLSEMFCFRNPDLSAEAGAVLSMIERSNAVSVHIRRGDYQSEEHIEKFGRFCPPDYYRIATERIRQREDDPLFFVFSDDMMWVKSNMDVPNAVYVDCHHGDDSWKDMFLMAKCRHNIIANSTFSFWAAMLNANPDKVVVYPQRWFCWPSPDIFPEMWLPVTEKEIKSSF

SEQ ID NO: 240 - protein, 290 aa, Bacteroides sp. CAG:462
MIIVNMACGLANRMFQYAFYLSLKERGYNVKVDFYKSATLPHENVPWNDIFPYAEIDQVSNFRVLILGGGANLLSKLRRKYLPSLTNVITMSTAFDTDLQIDDDRKDKYIIGVFQSAAMVEGVCKKVKQCFSFLPFTDLRHLQLEKEMQECESVAIHVRKGNDYQQRIWYQNTCTMDYYRKAIAEIKGKVKDPRFYVFTDNADWVRRNFTDFDYKMVEGNPVYGWGSHFDMQLMSRCKYNIISNSTYSWWGAYLNANRNKIVICPNIWFNPESCNEYTSCKLLCKGWIAL

SEQ ID NO: 241 - protein, 557 aa, Desulfovibrio africanus
MRIGILYICTGKYTVFWNHFFTSCEQHFLREHEKHYYIFTDGEIAHLNCNRVHRIEQQHLGWPDSTLKRFHMFERIADTLRQNSDFIVFFNANMVFLRDVGKEFLPTREQALVFHRHPGLFRRPAWLLPYERRPESTAYIPYGSGSIYVCGGVNGGYTQPYLDFVAMLRRNIDIDVERGIIARWHDESHINRFVIGRHYKIGHPGYVYPDRRNLPFPRIIRVIDKASVGGHTFLRGQTPEPAPEEQSKTVAKKLRSQLKRPCMPRAAQDEPIILARMMGGLGNQMFIYAAARVLAERQGAQLHLDTGKLSGDSIRQYDLPAFSIDAPLWHIPCGCDRIVQAWFALRHVAAGCGMPKPTMQVLRSGFHLDQRFFSIRHSAYLIGYWQSPHYWRGHEDRVRSSFDLTRFERPHLREALAAVSQPNTISVHLRRGDFRAPKNSDKHLLIDGSYYERARKLLLEMTPQSHFYIFSDEPEEAQRLFAHWENTSFQPRRSQEEDLLLMSRCSASIIANSSFSWWGAWLGRPKQHVIAPRMWFTRDVLMHTYTLDLFPEKWILL

SEQ ID NO: 242 - protein, 299 aa, Roseburia sp. CAG:100
MILIHVMGGLGNQLYQYALYEKMKSLGKKVKLDTYAYNDAAGEDKEWRSLELDRFPAIEYDKATSEDRTKLLDNSGLLTAKIRRKLLGRKDKTIRESKEYMPEIFHMDDVYLYGFWNCERYYEDIIPLLQDKLQFPISNNPRNQQCIEQMQKENAVSIHIRRTDYLTVADGARYMGICTEDYYKGAMAYIEERVSNPVYYIFSDDVEYAKQHYHQDNMHVVDWNSKADSIYDMQLMSKCKHNICANSTFSMWAARLNQNKEKIMIRPLHHDNYETTTATQVKQNWKNWILLDQNGQVCE

SEQ ID NO: 243 - protein, 326 aa, Desulfovibrio africanus
MTMNIIRMSGGLGSQMFQYALYLKLKSMGKEVKFDDINEYRGEKARPIMLAVFGIEYPRATWDEITSFTDGSMDLLKRLRRKIFGRKAIEYEEQGFYDPNVLNFDSMYLRGNFQSEKYFQDIKEEVRKLYRFSTLEDMRLPERLYKATKACLDGIESSESVGLHMYRSDSRVDGELYDGICTGNYYKGAVRFIQDKVPDAKFYIFSNEPKWVRGWVVDLIQSQIQEGMSPSQVKEMEKRFVMVEANTEYTGYLDMMLMSKCKHNIISNSSFSWWSAWMNDHPEKVVVAPDRWSSDKEGNEIYTTGMTLVNEKGRVNYTIHENSTVK

SEQ ID NO: 244 - protein, 311 aa, Prevotella nigrescens
MILSYITGRLGNQLFEYAYARSLLLKRGKNEELILNFSLVRAAGKEIEGFDDNLRYFNVYSYTELDKDIVLSKGDLLQLFIYILFKLDQKLFRIIKKEKWFSFFRRFGIIFQDYLDNISNLIIPRTKNVFCYGKYENPKYFDDIRSILLKEFTPRIPPLKNNDQLYSVIESTNSVCISIRRGDFLCDKFKDRFLVCDKEYFLEAMEEAKKRISNSTFIFFSDDIEWVRENIHSDVPCYYESGKDPVWEKLRLMYSCKHFIISNSTFSWWAQYLSRNEEKVVIAPDRWSNVPGEKSFLLSNSFIKIPIGILP

SEQ ID NO: 245 - protein, 279 aa, Bacteroides sp. CAG:875
MIYVEINGRLGNNMFEIAAAKSLTDEVTLWCKGDWQLNCIKMYSDTLFKNYPIVKSLPNNIRIYEEPEFTFHPIPYKENQDLLIKGYFQSYKYLDREKVLKLYPCPMPVKLDIEKRFGDILSQYTVVSINVRRGDYLNLPHRHPFVGKKFLERAMLWFGDKVHYIISSDDIEWCKAHFKQFDNVHYLTNSYPLLDLYIQTACHHNIISNSSFSWWGAYLNNHPQKIVIAPHRWFGMSTNINTQDLLPPEWMIEQCVYEPKVFLKALPLHAKYLLKRVLK

SEQ ID NO: 246 - protein, 292 aa, Prevotella sp. oral taxon 299
MDSQLLKHIKLSGGFGNQLFQYFFGEYLKEKYNCSISFFSEPALDINQLQIHRFFPTLRISHNTELRRFHYAFTQQLAYRCMRKLLLLFPFLNRKVKIENGSNYQNQSFNDTYCFDGYWQSYRYLSAFTPSLQFEDQLINDISADYINAIEQSEAVFLHIRRGDYLNKENQKVFAECPLNYFENAVNKIKEGNKTYHFFVFSNDIEWVKCHLKLNNNEVTFIQNEGSSCDLKDFYLMTRCKHAIISNSTFSWWAAYLINNNDKKVIAPKRWYNDLSMNNATKDLIPPTWIRL

SEQ ID NO: 247 - protein, 265 aa, Paraprevotella xylaniphila
MKIVCLKGGLGNQMFEYCRFRDLMDSGNGKVYLFYDRRRLKQHDGLRLSDCFELELPSCPWGIRLVVWGLKICRAIGVLKRLYDDEKPDAVLIDDYSQHRRFIPNARRYFSFRQFLAELQSGFVQMIRAVDYPVSVHVRRGDYLHPSNSSFVLCGVDYFRQAIAYVRKKRPDARFFFFSDDMEWVRENLWMEDAVYVEHTELMPDYMDLYLMTLCRGHIISNSTFSFWGAYLAVDGNGMKIYPRRWFRDPTWITPPIFSEEWVGL

SEQ ID NO: 248 - protein, 281 aa, Dethiosulfovibrio peptidovorans
MFQYAFGRALALDLGLDLKLDISNFGSDSRPFSLGIYSLTKNIPFGCYLSTSTRLKVKMTKKLRRWGVWGMDKNMPGVLVEPFPPVLVSLDEVLSEKLSHLFVDGYWQSEKYFSRYSDVIRSDFRVIEESSAFLAWKKRMLSEPGGSISVHVRRGDYVTDSSANRVHGVLPIEYYLRAKEILNTISDGLVFYVFTDDPVWARNNLCLGDKTIYVSGEDLKDYEELALMSCCDHHVVANSSFSWWGAWLGQDTSTVTIAPGRWFRKMDSSFVIPDNWIKIWT

SEQ ID NO: 249 - protein, 299 aa, Lachnospiraceae bacterium 10-1
MIIIQVMGGLGNQLQQYALYRKFVRMGKEARLDISWFLDKEKRGEVLAERELELDYFDRLIYETCTPEEKEQLIGSEGVAGKLKRKFLPGRIRWFHESKIYHPELLQMENMYLSGYFACEKYYADILYDLREKIQFPVNDHPKNIKMAQEMQERESVSVHLRRGDYLDEKNTAMFGNICTDAYYCKAIEYMKTLCSKPHFYIFSDDIPYVRQRFTGEEYTVVDINHGRDSFFDMWLMSRCRHNICANSTFSFWGARLNSNDNKIMIRPTIHKNSQVFVKEEMEQLWPGWKFISPDGGIK

SEQ ID NO: 250 - protein, 292 aa, Treponema maltophilum
MFCAAFVEALKHAGQKVFVDTSLYNKGTVRSGIDFCHNGLETEHLFGIKFDEADKADVHRLSTSAEGLLNRIRRKYFTKKTHYIDTVFRYTPEVLSDKSDRYLEGFWQTEKYFLPIESDIRTLFRFRQPLSEKSAAVQSALQAQEPASLSASIHVRRGDFLHTKTLNVCTETYYNNAIEYAAKKYAVSAFYVFSDDIQWCREHLNFFGARSVFIDWNIGADSWQDMVLMSMCRCNIIANSSFSWWAAWLNAASDKIVLAPAIWNRRQLEYADRYYGYDYSDVIPETWIRIPI

SEQ ID NO: 251 - protein, 266 aa, Bacteroides massiliensis
MKLVSFTAGLGNQLFQYCFYRYLLNKFPNEKIYGYYNKKWLKKHGGIIIEHFFDVKLPRSTRWINLYGQYLRIIYKCFSCGVSKDDDFEMNRTMFVGYWQDQCFFSGINISYKKNLVISEKNTWLLGEILKCNSVAIHFRRGDYMLPQFKKIFGEVCTVKYYLKSIRKVEEKISEPVFFVFSDDIDWVKQNFTFNKVYFVDWNKGQNSFWDMYLMSQCSANIIANSTFSFWGAYLNKNNPFVIYPQKWVRTNLKQPNIFPKTWMAL

SEQ ID NO: 252 - protein, 303 aa, Enterococcus faecium
MIVLTLGGGLGNQMFQYGYARYIQKIHREKFIYINDSEVIKEADRFNSLGNLNTVNIKVLPRIISKPLNETERLVRKIMVRLFGVAGFNESAIFQSLNKFGIYYHPSVYKFYESLKTGFPIKIIEGGFQSWKYLETCPEIKQELRVKYEPMGENLRLLNLISQSESVCVHIRRGDYLSPKYKHLNVCDYQYYFESMNYIISKLNNPTFFIFSNTSDDLDWIKENYSLPGKIVYVKNDNPDYEELRLMYSCKHFIISNSTFSWWAQYLSNNSGIVIAPEIWNRLNHDGIADLYMPNWITMKVNR

SEQ ID NO: 253 - protein, 290 aa, Bacteroides ovatus
MDVVVIFNGLGNQMSQYAYYLAKKKVNPNTKVIFDIMSKHNHYGYDLERAFGIEVNKTLLIKVLQIIYVLSRKFRLFKSVGVRTIYEPLNYDYTPLLMQKGPWGINYYVGGWHSEKNFMNVPDEVKKAFMFREQPNEDRFNEWLQVIRGDNSSVSVHIRRGDYMNIEPTGYYQLNGVATLDYYHEAIDYIRQYVDTPHFYVFSNDLDWCKEQFGVENFFYIECNQGVNSWRDMYLMSECHYHINANSTFSWWGAWLCKFEDSITVCPERFIRNVVTKDFYPERWHKIKSC

SEQ ID NO: 254 - protein, 271 aa, Synechococcus phage S-SM2
MIGFNALGRMGRLANQMFQYASLKGIARNTGVDFCVPYHEEAVNDGIGNMLRTEIFDSFDLQVNVGLLNKGHAPVVQERFFHFDEELFRMCPDHVDIRGYFQTEKYFKHIEDEIREDFTFKDEILNPCKEMIAGVDNPLALHVRRTDYVTNSANHPPCTLEYYEAALKHFDDDRNVIVFSDDPAWCKEQELFSDDRFMISENEDNRIDLCLMSLCDDFIIANSTYSWWGAWLSANKDKKVIAPVQWFGTGYTKDHDTSDLIPDGWTRIATA

SEQ ID NO: 255 - protein, 294 aa, Geobacter metallireducens
MDIHVLSYGLGNQLSQYAFFINRRQLMQRAYAFYAFKQHNGYELDRIFGLKEGLPWYLQFVRVVFRLGISRRFYSKRTADFVLSLFRIKVIDEAYNYEFDPSLLKPWFGIRILYGGWHDSRYFHPSEAAVRTAFSFPPLDDVNDAILQQIDAVYGVSIHVRRGDYLKGINSNLFGGIATLEYYRNAIGWAITYCKHRSLEIKFYVFSDDIDWCKQNLGLRDAVYVSGNSKTDSWKDILLMSHCRANIIANSTFSWWAAWLNQQPNKVVICPTKFINTDSPNQTIYPAAWHQIEG

SEQ ID NO: 256 - protein, 299 aa, Lachnospiraceae bacterium NK4A136
MIIVRFHGGLGNQMFEYAFYRYMTNKYGADNVIGDMTWFDRNYSEHQGYELKKVFDIDIPAIDYKTLAKIHEYYPRYHRFAGLRYLSRMYAKYKNKHLKPTGEYIMDFGPSQYIHNDAFDKLDTNKDYYIEGVFCSDAYIKYYENQIKKDLTFKPNYSQHTKDMLPKIEETNSVAIHVRRGDYVGNVFDIVTPDYYRQAVNYIRERVENPVFFVFSDDMDYIKANFDFLGDFVPVHNCGKDSFQDMYLISRCRHMIIANSSFSYFGALLGEKDSTIVIAPKKYKADEDLALARENWVLL

SEQ ID NO: 257 - protein, 290 aa, Bacteroides coprophilus
MGFIVNMACGLANRMFQYSYYLFLKKQGYKVTVDFYRSAKLAHEKVAWNSIFPYAEIKQASRLKVFLWGGGSDLCSKVRRRYFPSSTNVRTTTGAFDASLPANTARNEYIIGVFLNASIVEAVDDEIKKCFTFLPFTDEMNLRLKKEIEECESVAIHVRKGKDYQSRIWYQNTCSMEYYRKAILQMKEKLQHSKFYVFTDNVDWVKENFQEIDYTLVEGNPADGYGSHFDMQLMSLCKHNIISNSTYSWWSAFLNRNPEKVVIAPEIWFNPDSCDEFRSDRALCKGWIVL

SEQ ID NO: 258 - protein, 265 aa, Paraprevotella clara YIT 11840
MKIVCLKGGLGNQMFEYCRFRDLMESGHDEVYLFYDHRRLKQHNGLRLSDCFELELPSCPWGIKLVVWGLKICRAVGVLKRLYDDEKPEAVLIDDYSQHRRFIPNARRYFFFRQFLAELQSGFVQMIRAVDYPVSVHVRRGDYLHPSNSSFGLCGVDYFQQAIAYVRKKRPDARFFFFSDDMEWVRENLWMEDAVYVEHTELLPDYVDLYLMTLCRGHIISNSTFSFWGAYLAVDGNGMKIYPRRWFRDPTWTSPPIFSEEWVGL

SEQ ID NO: 259 - protein, 309 aa, Butyrivibrio sp. NC2007
MLIIQIAGGLGNQMQQYAVYTKLREMGKDVKLDLSWFDPQVQKNMLAPREFELPIFGGTDYEECSAYERDALLKQGAFAAIAGKVLKKLGLRDEANPKVFSEKEMYHPEVFELEDKYIKGYFACQKYYGDIMDKLQEKFIFPEHSDPDLHARNMALVERMEREPSVSVHIRRGDYLDPSNVEILGNIATEQYYQGAMDYFTVKEPDTHFYIFTSDHEYAREKFSDESKYTIVDWNNGKNSVQDLMLMSHCKGNICANSTFSFWGARLNKRPDKTVIRTYKMRNNQPVNPQIMHDYWKGWILMDEKGSII

SEQ ID NO: 260 - protein, 273 aa, Paraprevotella xylaniphila
MKILVFTGGLGNQMFAYAFYLYLKRLFPQERFYGLYGKKLSEHYGLEIDKWFKVSLPRQPWWVLPVTGLFYLYKQCVPNSKWLDLNQEICKNPRAIVFFPFKFTKKYIPDDNIWLEWKVDESGLSEKNRLLLSEIRSSDCCFVHVRRGDYLSPTFKSLFEGCCTLSYYQRALKSMKEISPFVKFVCFSDDIQWVKQNLELGNRAVFVDWNSGTDSPLDMYLMSQCRYGIMANSTFSYWGARLGRKKKRIYYPQKWWNHGTGLPDIFPNTWVKI

SEQ ID NO: 261 - protein, 310 aa, Blautia hydrogenotrophica DSM 10507
MEIHVYLTGRLGNQLFQYAFARHLQKEYGGKIICNIYELEHRSEKAAWVPGKFNYEMSNYKLNDSILIEDIKLPWFADFSNPIIRIVKKVIPRIYFNLMASKGYLLWQKNSYINIPAIRNNEIIVNGWWQDVRFFHDVEAELSNEIVPTTKPISENEYLYNIAERENSVCVSIRGGNYLVPKVKKKLFVCDKEYFYNAIELIKSKVRNAIFIVFSDDLEWVKSYIKLEEKFPECKFYYESGKDTVEEKLRMMTKCKHFIISNSSFSWWAQYLAKNENKIVIAPDAWFTNGDKNGLYIDDWILIPTQTKDM

SEQ ID NO: 262 - protein, 291 aa, Geobacter lovleyi
MITVLLNGGLGNQLFQYAAGRALAEKHDVELLLDLSRLQHPKPGDTPRCFELAPFNIKASLLAEEGRQPLGSYQACMHRLLLKASIPLWGSIILKEQGCGFDPLIFRAPSSCILDGFWQSECYFKQITSLLQQELSLKAPSPALRKASSVLSDATVAVHVRRGDYVTNPAAASFHGICSQDYYQAAVANILTSYPDSQFLVFSDDPAWCQEHLDLGQPFRLAADFGLNGSAEELVLISRCAHQIIANSSFSWWGAWLNPSPHKLVVAPCRWFTDPAITTNDLLPETWVRLP

SEQ ID NO: 263 - protein, 290 aa, Lachnospiraceae bacterium NK4A136
MVISHLSGGFGNQLYSYAFAYAVAKARKEELWIDTAIQDAPWFFRNPDILNLNIKYDKRVSYKIGEKKIDKIFNRINFRNAIGWNTKIINESDMPNIDDWFDTCVNQKGNIYIKGNWSYEKLFISVKQEIIDMFTFKNELSKEANDIAQDINSQETSVGIHYRLGDYVKIGIVINPDYFISAMTSMVEKYGNPVFYSFSEDNDWVKKQFEGLPYNIKYVEYSSDDKGLEDFRLYSMCKHQIASNSSYSWWGAYLNNNPNKYIIAPTDYNGGWKSEIYPKHWDVRPFEFLK

SEQ ID NO: 264 - protein, 269 aa, Bacteroides vulgatus
MFHYKFLLFGGGLGNQIFEYYFYLWLRKKYPNIVFLGCYRKASFKAHNGLEISDVFDVDLPNDGGLSGRFISYVLSVLSRIIPSLSMKANTEYSSKYLLINAYQPNLLFYLNEEKIKFRPFKLDEVNRRLLNSIKMESSVSIHVRRGDYLFGQYRDIYSNICTLAYYQKAVDKCKGILESPRFFVFSDDIEWARDVFVGREYEFVSNNIGKNSFIDMFLMSNCKIQIIANSTFSYWAAYLSNSLVKIYPAKWINGIERPNIFPDNWIGL

SEQ ID NO: 265 - protein, 287 aa, Planctomyces brasiliensis
MIIARIENGLGNQLFKYAAGRALSLKHRTSLYTIPGSVRKPHETFILSKYFNVQAKSVSPFLLQTGFRLRLLKGYENHSFGFDPRFETTRNNTVVSGNFQSARYFLPFFDQINRELTLKPEVVDGLESVYPHVLESLRTPNSVCVHIRLGDYVSSGYDICGPEYYAKAISRLQQLHGELRAFVFSDTPQAASRFLPADIDAQIMSEFPEVRDAARSLTVERSTIRDYFLMQQCRHFVIPNSSFSYWAALLSSSDGDVIYPNRWYIDIDTSPRDLGLAPAEWTPIPLT

SEQ ID NO: 266 - protein, 309 aa, Butyrivibrio sp. AE2015
MIILQIAGGLGNQMQQYALYRKLLKCGKTVKLDLSWFGPEIQKNMLAPREFELVLFKDLPFEICTKEEKDALIKQNLFQKIAGKVSQKLGKSASSNAKVFVETKMYHEEIFDLDDVYITGYFACQYYYDDVMAELQDLFVFPSHSIPELDQRNAVLASKMEKENSVSVHIRRGDYLSPENVGILGNIASDKYYESAMNYFLEKDENTHFYIFTNDHEYAREHYSDESRYTIIDWNTGKNSLQDLMLMSHCKGNICANSTFSFWGARLNKRPDRELVRTLKMRNNQEAQPEIMHEYWKNWILIDENGVIV

SEQ ID NO: 267 - protein, 291 aa, Roseovarius nubinhibens
MTDTPPPSQVITSRLFGGAGNQLFQYAAGRALADRLGCDLMIDARYVAGSRDRGDCFTHFAKARLRRDVALPPAKSDGPLRYALWRKFGRSPRFHRERGLGVDPEFFNLPRGTYLHGYWQSEQYFGPDTDALRRDLTLTTALDAPNAAMAAQIDAAPCPVSFHVRRGDYIAAGAYAACTPDYYRAAADHLATTLGKPLTCFIFSNDPAWARDNLDLGQDQVIVDLNDEATGHFDMALMARCAHHVIANSTFSWWGAWLNPDPDKLVVAPRNWFATQALHNPDLIPEQWHRL

SEQ ID NO: 268 - protein, 300 aa, Eubacterium sp. CAG:581
MIEVNIVGQLGNQMFEYACARQLQKKYGGEIVLNTYEMRKETPNFKLSILDYKLSENVKIISDKPLSSANANNYLVKIMRQYFPNWYFNFMAKRGTFVWKSARKYKELPELNEQLSKHIVLNGYWQCDKYFNDVVDTIREDFTPKYPLKAENEQLLEKIKSTESVCVTIRRGDFMNEKNKDTFYICDDDYFNKALSKIKELCPDCTFFGFSDDVEWIKKNVNFPGEVYFESGNDPVWEKLRLMSACKHFVLSNSSFSWWAQYLSDNNNKIVVAPDIWYKTGDPKKTALYQDGWNLIHIGD

SEQ ID NO: 269 - protein, 303 aa, Providencia alcalifaciens
MKINGKESSMKIKQKKIISHLIGGLGNQLFQYATSYALAKENNAKIVIDDRLFKKYKLHGGYRLDKLNIIGEKISSIDKLLFPLILCKLSQKENFIFKSTKKFILEKKTSSFKYLTFSDKEHTKMLIGYWQNAIYFQKYFSELKEMFVPLDISQEQLDLSIQIHAQQSVALHVRRGDYISNKNALAMHGICSIDYYKNSIQHINAKLEKPFFYIFSNDKLWCEENLTPLFDGNFHIVENNSQEIDLWLISQCQHHIIANSTFSWWGAWLANSDSQIVITPDPWFNKEIDIPSPVLSHWLKLKK

SEQ ID NO: 270 - protein, 301 aa, Salmonella enterica
MFSCLSGGLGNQMFQYSAAYILKKNICHAQLIIDDSYFYCQPQKDTPRNFEINQFNIVFDRVTTDEEKRAISKLRKFKKIPLPLFKSNVITEFLFGKSLLTDEDFYKVLKKNQFTVKMNACLFSLYQDSSLINKYRDLILPLFTINDELLQVCQQLDSYGFICEHTNTTSLHIRRGDYVTNPHAAKFHGTLSMNYYSQAMNYVDHKLGKQLFIIFSDDVQWAAEKFGGRSDCYIVNNVNCQFSAIDMYLMSLCNNNIIANSTYSWWGAWLNKSEEKLVIAPRKWFAEDKESLLAVNDWISI

SEQ ID NO: 271 - protein, 289 aa, Sulfurospirillum deleyianum
MIIIKIMGGLASQLHKYSVGRALSLKYNTELKLDIFWFDNISGSDTIREYHLDKYNVVAKIATEQEIKQFKPNKYLLKINNLFQKFTNWKINYRNYCNESFISLENFNLLPDNIYVEGEWSGDRYFSHIKEILQKELTLKSEYMDSTNHFLAKQSSDFAHDDNASKLHCTCSLEYYKKALQYISKNLLKMKLLIFSDDLDWLKPNFNFLDNVEFEFVEGFQDYEEFHLMTLSKHNIIANSGFSLFFAWLNINHNKIIISLSEWVFEEKLNKYIIDNIKDKNILFLENLE

SEQ ID NO: 272 - protein, 309 aa, Pseudovibrio sp. FO-BEG1
MSVASQVRISGAARRRKLKPTLIVRIRGGIGNQLFQYALGRKIALETGMKLRFDRSEYDQYFNRSYCLNLFKTQGLSATESEMSAVLWPAQSFGQTVKLCRKFYPFYQRRYIREDELLQDSETPVLKQSAYLDGYWQTWEIPFSIMEQLRDEITLKKPMVLERLKLLQRIKSGPSAALHVRYGDYSQAHNLQNFGLCSAGYYKGAMDFLTERVPGLTFYVFSDSPERAREVVPQQENVYFSDPMQDGKDHEDLMVMSSCDHIVTANSTFSWWAAFLNGNEDKHVIAPLKWFKNPNLDDSLIVPPHWQRL

SEQ ID NO: 273 - protein, 264 aa, Prevotella sp. oral taxon 472
MKIVCIKGGLGNQLFEYCRYHGLLRQHNNHGVYLHYDRRRTKQHGGVWLDKAFLITLPTEPWRVKLMVMALKMLRKLHLFKRLYREDDPRAVLIDDYSQHKQFITNAAEILNFRPFAQLDYVDEITSEPFAVSVHVRRGDYLLPANKANFGVCSVHYYLSAAVAVRERHPDARFFVFSDDIEWAKMNLNLPNCVFVEHAQPQPDHADLYLMSLCKGHIIANSTFSFWGAYLSMGSSAIAIYPKQWFAEPTWNAPDIFLGHWIAL

SEQ ID NO: 274 - protein, 304 aa, Butyrivibrio fibrisolvens
MLIIRVAGGLGNQMQQYAMYRKLKSLGKEVKLDLSWFDVENQEGQLAPRKCELKYFDGVDFEECTDAERAYFTKRSILTKALNKVFPATCKIFEETEMFHPEIYSFKDKYLEGYFLCNKYYDDILPFIQNEIVFPKHSDPKMQKRNEELMERMDGWHTASIHLRRGDYITEPQNEALFGNIATDAYYDAAIRYVLDKDYQTHFYIFSNDPEYAREHYSDESRYTIVTGNDGDNSLLDMELMSHCRYNICANSTFSFWGARLNKRSDKEMIRTFKMRNNQEVTAREMTDYWKDWILIDEKGNRIF

SEQ ID NO: 275 - protein, 294 aa, Lewinella persica
MVISRLHSGLGNQMFQYAFARRIQLQLNVKLRIDLSILLDSRPPDGYIKREYDLDIFKLSPAYHCNPTSLRILYAPGKYRWSQVVRDLARKGYPVYMEKSFSVDNTLLDSPPDNVIYQGYWQSERYFSEVANTIRKDFAFQHSIQPQSESLAREIRKEDSVCLNIRRKDYLASPTHNVTDETYYENCIQQMRERFSGARFFLFSDDLVWCREFFADFHDVVIVGHDHAGPKFGNYLQLMAQCHHYIIPNSTFAWWAAWLGERTGSVIMAPERWFGTDEFDYRDVVPERWLKVPN

SEQ ID NO: 276 - DNA, 916 bp, Artificial Sequence
  artifical construct
cagtcagtcagaattcaagaaggagatatacatatgaaaatcgtcaaaatcctgggcggtctgggcaatcagatgttccagtatgctctgtacctgagcctgcaagaaagttttccaaaagaacgtgtggccctggacctgtcctccttccacggctatcacctgcataatggctttgagctggagaacattttctccgttaccgctcagaaagcatccgccgcagatatcatgcgtattgcttattactacccgaactatctgctgtggcgcattggcaaacgttttctgccgcgtcgtaaaggtatgtgcctggaatctagctccctgcgtttcgatgaaagcgttctgcgtcaggaaggtaaccgttattttgacggttactggcaagacgaacgctacttcgcagcctatcgtgaaaaagtgctgaaggctttcacctttcctgcattcaaacgcgcagaaaacctgagcctgctggaaaaactggacgaaaacagcattgctctgcatgttcgtcgcggtgattacgtaggtaataacctgtaccaaggcatctgtgacctggactactaccgtaccgctatcgagaaaatgtgtgcacacgttactccgtctctgttttgtatcttttccaacgacatcacgtggtgccagcagcacctgcaaccgtacctgaaggcccctgtggtgtacgttacttggaacaccggtgttgaatcctaccgcgatatgcagctgatgtcctgctgcgcacataacatcatcgcgaatagctccttctcttggtggggtgcttggctgaatcagaaccgtgaaaaagttgttatcgccccgaaaaaatggctgaacatggaagaatgtcacttcacgctgccggcaagctggatcaaaatttagctcgagtgactgactg

SEQ ID NO: 277 - DNA, 886 bp, Artificial Sequence
  artifical construct
cagtcagtcagaattcaagaaggagatatacatatggtgattatcaaaatgatgggtggtctgggcaaccagatgttccagtacgcactgtacaaagcattcgagcagaagcacatcgatgtgtatgcagacctggcatggtacaaaaacaaatccgtgaaatttgaactgtacaacttcggcattaaaatcaacgtagcatccgagaaagacatcaaccgtctgagcgattgccaggcggactttgtttcccgcatccgccgtaaaatctttggtaaaaaaaagagcttcgtatctgaaaaaaatgactcctgctatgaaaacgacatcctgcgtatggacaacgtttatctgagcggttattggcagaccgaaaaatacttctctaacacgcgtgagaagctgctggaggattattccttcgctctggtaaactctcaggtgtccgaatgggaagactccattcgcaacaaaaacagcgttagcatccatatccgtcgtggtgattatctacagggcgaactgtatggtggtatttgcacctctctgtactacgccgaagcaatcgagtacattaaaatgcgtgttccgaacgcaaaattcttcgttttctctgatgacgttgaatgggttaaacagcaagaagacttcaaaggcttcgtaatcgttgatcgcaacgagtattctagcgctctgtccgatatgtacctgatgtccctgtgcaagcataacattattgctaactcctctttcagctggtgggcagcttggctgaaccgtaacgaagaaaaaattgtaatcgcgccgcgccgttggctgaacggcaagtgcaccccagatatctggtgtaaaaaatggattcgtatctagctcgagtgactgactg

SEQ ID NO: 278 - protein, 919 aa, Artificial Sequence
  artificial construct
CAGTCAGTCAGAATTCAAGAAGGAGATATACATATGGTGATCGTACAGCTGAGCGGCGGTCTGGGCAACCAGATGTTCGAATACGCGCTGTACCTGAGCCTGAAAGCAAAAGGCAAAGAAGTGAAAATTGACGATGTTACGTGTTACGAGGGCCCTGGCACCCGTCCGCGTCAACTGGATGTTTTTGGTATCACGTACGATCGCGCGTCTCGTGAGGAGCTGACTGAGATGACGGACGCGAGCATGGATGCGCTGTCTCGTGTTCGTCGCAAACTGACCGGTCGCCGCACTAAAGCGTACCGCGAACGCGACATCAACTTCGATCCACTGGTTATGGAAAAAGACCCGGCACTGCTGGAAGGCTGTTTCCAGTCTGACAAATACTTTCGTGATTGCGAAGGCCGCGTGCGCGAAGCGTATCGTTTCCGCGGCATTGAATCCGGCGCGTTCCCGCTGCCGGAAGACTATCTGCGCCTGGAAAAGCAGATCGAAGATTGTCAGTCCGTATCCGTACACATCCGTCGTGGCGACTACCTGGACGAATCTCATGGTGGTCTGTACACCGGCATTTGTACTGAGGCGTACTATAAAGAGGCTTTTGCTCGCATGGAACGTCTGGTTCCGGGCGCACGTTTCTTCCTGTTCTCTAACGATCCAGAATGGACTCGTGAGCACTTTGAGAGCAAGAACTGCGTTCTGGTTGAAGGTAGCACCGAAGACACGGGTTACATGGACCTGTACCTGATGAGCCGCTGCCGCCACAATATTATTGCCAACTCTTCTTTCAGCTGGTGGGGCGCTTGGCTGAATGAGAACCCTGAGAAAAAAGTCATCGCACCGGCTAAATGGCTGAACGGTCGTGAGTGCCGTGATATCTATACCGAACGCATGATTCGTCTGTAGCTCGAGTGACTGACTG

SEQ ID NO: 279 - protein, 937 aa, Artificial Sequence
  artifical construct
CAGTCAGTCAGAATTCAAGAAGGAGATATACATATGATCATTGTTCGTCTGAAAGGCGGTCTGGGCAACCAACTGTCTCAGTATGCACTGGGCCGTAAGATCGCGCATCTGCACAATACCGAACTGAAACTGGACACCACTTGGTTCACCACTATCTCCTCCGACACTCCACGTACCTACCGTCTGAACAATTATAACATCATCGGCACTATTGCATCCGCAAAGGAAATCCAGCTGATCGAACGTGGTCGCGCGCAAGGCCGTGGCTACCTGCTGTCTAAAATTTCTGATCTGCTGACTCCGATGTACCGTCGTACCTACGTCCGTGAACGTATGCATACCTTCGATAAAGCTATCCTGACCGTTCCGGACAACGTGTACCTGGATGGTTACTGGCAGACCGAAAAGTACTTCAAAGACATCGAAGAAATCCTGCGCCGTGAGGTTACGCTGAAAGATGAACCGGATAGCATCAACCTGGAAATGGCTGAACGTATTCAGGCTTGCCACAGCGTTTCCCTGCACGTGCGTCGTGGCGACTACGTTTCCAACCCGACCACTCAACAATTCCACGGCTGTTGCTCCATTGACTACTACAACCGCGCTATCTCTCTGATTGAAGAAAAAGTGGATGACCCGTCTTTCTTTATTTTTTCTGACGATCTGCCGTGGGCTAAAGAAAACCTGGACATCCCTGGCGAAAAAACCTTCGTTGCGCATAACGGCCCGGAAAAAGAGTATTGCGATCTGTGGCTGATGTCTCTGTGCCAGCACCATATCATCGCAAACTCTTCTTTCAGCTGGTGGGGTGCCTGGCTGGGTCAAGACGCCGAAAAGATGGTGATCGCGCCGCGTCGCTGGGCCCTGTCCGAGAGCTTTGACACTTCTGACATCATTCCGGACTCTTGGATTACTATCTAGCTCGAGTGACTGACTG

SEQ ID NO: 280 - DNA, 913 bp, Artificial Sequence
  artifical construct
cagtcagtcagaattcaagaaggagatatacatatggtacgcattgtggaaatcatcggcggtctgggtaaccagatgttccagtacgcattctccctgtacctgaaaaacaaatctcacatctgggaccgtctgtatgtggacatcgaggcgatgaaaacctacgatcgtcactatggtctggaactggagaaagttttcaatctgagcctgtgtccaatctctaaccgtctgcaccgcaacctgcaaaaacgctccttcgcaaaacactttgtaaagagcctgtacgagcactctgaatgcgagttcgacgaaccggtgtaccgtggcctgcgtccttatcgctattatcgcggctactggcaaaacgaaggttacttcgttgatattgaaccgatgatccgtgaggcttttcagttcaacgttaacatcctgagcaaaaagactaaagcgatcgcatccaaaatgcgccgtgaactgtccgtatctatccatgttcgccgtggtgattacgaaaacctgccggaagcgaaagcgatgcatggcggtatttgttctctggactattaccacaaagcgatcgacttcatccgccagcgtctggataataacatctgtttctatctgttctccgacgatatcaattgggtagaagaaaacctgcaactggaaaaccgttgcatcatcgactggaaccagggcgaagatagctggcaggacatgtacctgatgagctgctgccgccaccacattatcgcaaacagctctttctcctggtgggcggcatggctgaatccaaacaagaacaaaatcgtactgaccccgaacaaatggttcaaccatactgacgcagtgggtatcgtcccaaagtcctggattaaaattcctgtgttttagctcgagtgactgactg

SEQ ID NO: 281 - DNA, 919 bp, Artificial Sequence
  artificial construct
cagtcagtcagaattcaagaaggagatatacatatgaaaatcgttaaaatcctgggcggcctgggtaaccagatgtttcagtacgccctgttcctgtctctgaaagaacgcttcccgcatgaacaggtgatgattgacaccagctgcttccgcaattacccactgcacaacggtttcgaagtggatcgtatcttcgcccagaaagcaccggttgcctcttggcgtaacatcctgaaggttgcctacccgtacccgaactaccgtttctggaaaatcggtaaatacatcctgcctaaacgtaaaaccatgtgtgtagagcgtaaaaacttcagctttgacgccgcagtcctgacccgtaaaggcgattgctactatgatggctactggcagcatgaggaatatttctgtgatatgaaagaaacgatttgggaggctttctccttccctgagccggttgatggtcgtaacaaggagatcggtgccctgctacaggcatctgatagcgcttccctgcacgttcgtcgcggtgactacgtgaaccacccactgtttcgtggtatttgtgacctggactattataaacgtgccatccactacatggaagaacgcgtcaacccacagctgtactgcgttttcagcaacgatatggcctggtgcgagtcccacctgcgtgcactgctgccaggcaaagaagtagtttatgttgactggaacaagggtgcggaatcttacgttgatatgcgtctgatgagcctgtgccgtcacaacatcatcgctaactcttctttcagctggtggggcgcatggctgaaccgtaacccgcagaaagtggtggtagcgccggaacgttggatgaacagcccgattgaagacccagtgagcgacaaatggattaaactgtagctcgagtgactgactg

SEQ ID NO: 282 - protein, 922 aa, Artificial Sequence
  artificial construct
CAGTCAGTCAGAATTCAAGAAGGAGATATACATATGATCATCATCCAGCTGAAAGGTGGCCTGGGCAACCAAATGTTCCAGTACGCGCTGTACAAATCCCTGAAAAAACGTGGTAAAGAAGTTAAAATTGATGACAAAACTGGCTTCGTGAACGACAAACTGCGTATCCCGGTACTGTCCCGTTGGGGTGTTGAGTACGATCGTGCAACCGACGAAGAGATTATTAACCTGACCGACTCCAAAATGGACCTGTTCTCTCGCATCCGCCGTAAACTGACTGGCCGCAAAACGTTCCGTATCGACGAAGAATCCGGTAAATTCAACCCGGAAATCCTGGAAAAAGAGAACGCTTATCTGGTGGGTTATTGGCAGTGCGACAAGTACTTCGACGACAAAGATGTGGTTCGCGAAATTCGTGAAGCGTTCGAGAAAAAACCGCAGGAGCTGATGACCGACGCCAGCTCTTGGTCTACTCTACAGCAGATTGAATGCTGCGAGTCCGTATCCCTGCACGTACGTCGTACTGATTACGTGGACGAGGAACATATTCATATCCATAACATCTGTACGGAAAAATACTATAAAAACGCCATTGATCGTGTGCGTAAACAGTACCCGAGCGCAGTGTTCTTCATCTTCACCGATGATAAAGAATGGTGCCGCGACCACTTTAAAGGTCCGAACTTCATCGTAGTCGAACTGGAAGAAGGCGACGGTACCGACATCGCTGAAATGACTCTGATGTCCCGCTGTAAACATCACATCATCGCTAATTCTAGCTTTAGCTGGTGGGCGGCGTGGCTGAACGACTCCCCGGAAAAAATCGTGATCGCTCCTCAGAAATGGATTAACAACCGCGACATGGACGATATTTACACCGAGCGTATGACTAAAATCGCACTGTAGCTCGAGTGACTGACTG

SEQ ID NO: 283 - DNA, 898 bp, Artificial Sequence
  artificial construct
cagtcagtcagaattcaagaaggagatatacatatgcgcctggttaaaatgatcggcggtctgggtaatcagatgttcatctacgcgttttacctacagatgcgtaagcgtttctccaacgttcgtatcgacctgaccgatatgatgcactacaacgtacactatggctacgaactgcacaaagttttcggtctgccgcgcaccgagttctgtatgaaccagcctctgaaaaaggttctggagttcctgttcttccgtaccattgttgaacgtaaacagcacggtcgtatggagccgtatacttgccagtatgtttggccgctggtttactttaagggcttctatcagtccgaacgttacttctccgaagttaaggacgaagttcgtgagtgtttcaccttcaatccggcactggcgaatcgttcttcccaacagatgatggaacagatccagaatgatcctcaggctgtctctatccacatccgtcgtggcgactatctgaatccgaagcactacgacactatcggttgtatctgtcagctgccgtattacaagcacgccgtttccgaaattaaaaagtacgtttctaaccctcacttttacgttttctccgaagacctggattgggtcaaagcaaacctgccgctggaaaacgcacagtacatcgattggaacaaaggcgcagatagctggcaggatatgatgctgatgagctgttgcaaacaccacattatctgtaactccacctttagctggtgggcggcgtggctgaacccatctgtcgaaaaaaccgtgatcatgccggaacagtggacgtctcgtcaagattccgtggactttgtggctagctgtggccgttgggtccgtgttaaaacggagtagctcgagtgactgactg

SEQ ID NO: 284 - DNA, 895 bp, Artificial Sequence
  artificial construct
cagtcagtcagaattcaagaaggagatatacatatgcgtctgatcaagatgatcggcggcctgggtaaccagatgtttatctacgcgttctacctgaaaatgaaacaccattacccggatacgaacatcgatctgtctgacatggttcattataaagttcacaacggttatgagatgaaccgtatctttgacctgagccagactgaattttgcatcaaccgtaccctgaaaaaaatcctggagttcctgttcttcaaaaaaatctacgaacgtcgccaggacccgtctactctgtatccatacgaaaaacgttatttttggccgctgctgtactttaaaggtttctaccagtctgaacgcttcttcttcgatatcaaagacgacgttcgtaaagccttctcttttaacctgaacatcgctaacccggaaagcctggaactgctgaaacagatcgaagttgacgaccaagctgtttctatccacatccgccgtggtgactacctgctgccgcgtcactgggcaaacacgggttccgtgtgccagctgccgtattacaagaacgcgatcgcggaaatggagaaccgtattactggcccgagctactacgtgttctctgatgatatctcttgggttaaagaaaacatcccgctgaagaaagcggtctacgtgacgtggaacaagggcgaagacagctggcaggatatgatgctgatgagccactgtcgtcaccacattatctgtaattctacgttctcctggtggggtgcttggctgaacccacgtaaagagaaaatcgtcatcgcgccgtgtcgctggttccagcataaagaaaccccggacatgtacccgaaagaatggatcaaagtaccgattaactagctcgagtgactgactg

SEQ ID NO: 285 - protein, 946 aa, Artificial Sequence
  artificial construct
CAGTCAGTCAGAATTCAAGAAGGAGATATACATATGTATTCTTGCCTGTCTGGTGGCCTGGGTAACCAAATGTTTCAATACGCAGCAGCGTATATCCTGAAGCAGTATTTTCAGTCTACCACTCTGGTCCTGGATGATAGCTATTACTATTCCCAGCCGAAACGTGATACCGTTCGTAGCCTGGAACTGAATCAGTTCAACATCTCTTATGATCGTTTTAGCTTCGCGGATGAAAAAGAGAAGATCAAACTGCTGCGCAAATTCAAACGTAACCCGTTCCCTAAACAGATTTCCGAGATCCTGTCTATTGCGCTGTTCGGCAAATACGCGCTGTCCGACCGTGCATTTTACACCTTCGAAACTATCAAAAACATCGACAAAGCGTGCCTGTTCTCCTTTTACCAGGACGCCGATCTGCTGAATAAATATAAGCAGCTGATCCTGCCGCTGTTCGAACTGCGCGATGACCTGCTGGATATCTGCAAGAACCTGGAACTGTATTCCCTGATCCAACGCAGCAACAATACCACTGCACTGCATATCCGCCGTGGCGACTACGTGACCAACCAGCACGCCGCGAAATACCACGGCGTGCTGGACATCAGCTACTATAACCACGCAATGGAATACGTGGAACGTGAACGCGGCAAACAGAACTTCATTATCTTCAGCGATGATGTACGTTGGGCACAGAAAGCGTTTCTGGAGAACGATAATTGCTACGTGATTAACAACTCCGACTACGATTTCTCTGCGATCGATATGTATCTGATGTCTCTGTGCAAAAACAACATCATCGCAAATTCCACCTACTCCTGGTGGGGTGCGTGGCTGAACAAATACGAGGACAAACTGGTTATCTCTCCGAAACAATGGTTTCTGGGTAACAACGAAACCTCTCTGCGTAACGCGTCTTGGATCACCCTGTAGCTCGAGTGACTGACTG

SEQ ID NO: 286 - DNA, 895 bp, Artificial Sequence
  artificial construct
cagtcagtcagaattcaagaaggagatatacatatgcgtctgatcaagatgaccggtggcctgggtaaccagatgttcatctacgcgttttatctgcgtatgaaaaaacgttatccgaaagttcgtattgatctgtctgatatggttcattatcacgttcaccacggctatgaaatgcaccgtgttttcaatctgccgcacaccgaattttgcatcaaccagccgctgaaaaaagtgatcgagttcctgtttttcaaaaagatttacgaacgtaaacaggaccctaattctctgcgtgcattcgagaagaagtatctgtggccgctgctgtacttcaaaggtttctatcaatctgagcgcttctttgctgacatcaaagacgaggttcgtaaagcattcacctttgactcttctaaagtgaacgctcgctctgccgaactgctgcgtcgcctggatgccgatgctaacgcggttagcctgcacattcgtcgcggtgactatctacagccgcagcattgggctaccactggttctgtctgccagctgccgtactaccagaacgcgatcgctgaaatgaaccgtcgcgttgctgccccgagctactacgttttcagcgatgacatcgcgtgggtgaaggaaaacatccctctacagaacgcagtgtacatcgactggaataaaggcgaagaaagctggcaggatatgatgctgatgagccactgccgccaccacattatctgtaacagcaccttctcttggtggggcgcgtggctggacccgcacgaggacaaaattgtaatcgttccgaatcgttggttccagcattgcgaaactcctaacatctatccggcaggctgggtgaaagttgcgattaattagctcgagtgactgactg

SEQ ID NO: 287 - DNA, 6153 bp, Artificial Sequence
  artificial construct
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatatgcggtgtgaaataccgcacagatgcgtaaggagaaaataccgcatcaggcgcctcctcaacctgtatattcgtaaaccacgcccaatgggagctgtctcaggtttgttcctgattggttacggcgcgtttcgcatcattgttgagtttttccgccagcccgacgcgcagtttaccggtgcctgggtgcagtacatcagcatggggcaaattctttccatcccgatgattgtcgcgggtgtgatcatgatggtctgggcatatcgtcgcagcccacagcaacacgtttcctgaggaaccatgaaacagtatttagaactgatgcaaaaagtgctcgacgaaggcacacagaaaaacgaccgtaccggaaccggaacgctttccatttttggtcatcagatgcgttttaacctgcaagatggattcccgctggtgacaactaaacgttgccacctgcgttccatcatccatgaactgctgtggtttctgcagggcgacactaacattgcttatctacacgaaaacaatgtcaccatctgggacgaatgggccgatgaaaacggcgacctcgggccagtgtatggtaaacagtggcgcgcctggccaacgccagatggtcgtcatattgaccagatcactacggtactgaaccagctgaaaaacgacccggattcgcgccgcattattgtttcagcgtggaacgtaggcgaactggataaaatggcgctggcaccgtgccatgcattcttccagttctatgtggcagacggcaaactctcttgccagctttatcagcgctcctgtgacgtcttcctcggcctgccgttcaacattgccagctacgcgttattggtgcatatgatggcgcagcagtgcgatctggaagtgggtgattttgtctggaccggtggcgacacgcatctgtacagcaaccatatggatcaaactcatctgcaattaagccgcgaaccgcgtccgctgccgaagttgattatcaaacgtaaacccgaatccatcttcgactaccgtttcgaagactttgagattgaaggctacgatccgcatccgggcattaaagcgccggtggctatctaattacgaaacatcctgccagagccgacgccagtgtgcgtcggtttttttaccctccgttaaattcttcgagacgccttcccgaaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagctttctttaatgaagcagggcatcaggacggtatctttgtggagaaagcagagtaatcttattcagcctgactggtgggaaaccaccagtcagaatgtgttagcgcatgttgacaaaaataccattagtcacattatccgtcagtcggacgacatggtagataacctgtttattatgcgttttgatcttacgtttaatattacctttatgcgatgaaacggtcttggctttgatattcatttggtcagagatttgaatggttccctgacctgccatccacattcgcaacatactcgattcggttcggctcaatgataacgtcggcatatttaaaaacgaggttatcgttgtctcttttttcagaatatcgccaaggatatcgtcgagagattccggtttaatcgatttagaactgatcaataaattttttctgaccaatagatattcatcaaaatgaacattggcaattgccataaaaacgataaataacgtattgggatgttgattaatgatgagcttgatacgctgactgttagaagcatcgtggatgaaacagtcctcattaataaacaccactgaagggcgctgtgaatcacaagctatggcaaggtcatcaacggtttcaatgtcgttgatttctctttttttaacccctctactcaacagatacccggttaaacctagtcgggtgtaactacataaatccataataatcgttgacatggcataccctcactcaatgcgtaacgataattccccttacctgaatatttcatcatgactaaacggaacaacatgggtcacctaatgcgccactctcgcgatttttcaggcggacttactatcccgtaaagtgttgtataatttgcctggaattgtcttaaagtaaagtaaatgttgcgatatgtgagtgagcttaaaacaaatatttcgctgcaggagtatcctggaagatgttcgtagaagcttactgctcacaagaaaaaaggcacgtcatctgacgtgccttttttatttgtactaccctgtacgattactgcagctcgagctagttaatcggtactttgatccattctttcgggtacatgtccggggtttctttatgctggaaccagcgacacggcgcgatgacgattttctctttacgtgggttcagccaagcaccccaccaggagaacgtagaattacagataatgtggtgacgacagtggctcatcagcatcatatcctgccagctgtcttcgcccttgttccacgtcacgtagaccgctttcttcagcgggatgttttctttaacccaagagatatcatcagagaacacgtagtagctcgggccagtaatacggttctccatttccgcgatcgcgttcttgtaatacggcagctggcacacggaacccgtgtttgcccagtgacgcggcagcaggtagtcaccacggcggatgtggatagaaacagcttggtcgtcaacttcgatctgtttcagcagttccaggctttccgggttagcgatgttcaggttaaaagagaaggctttacgaacgtcgtctttgatatcgaagaagaagcgttcagactggtagaaacctttaaagtacagcagcggccaaaaataacgtttttcgtatggatacagagtagacgggtcctggcgacgttcgtagatttttttgaagaacaggaactccaggatttttttcagggtacggttgatgcaaaattcagtctggctcaggtcaaagatacggttcatctcataaccgttgtgaactttataatgaaccatgtcagacagatcgatgttcgtatccgggtaatggtgtttcattttcaggtagaacgcgtagataaacatctggttacccaggccgccgatcatcttgatcagacgcatatgtatatctccttcttgaattctaaaaattgattgaatgtatgcaaataaatgcatacaccataggtgtggtttaatttgatgccctttttcagggctggaatgtgtaagagcggggttatttatgctgttgtttttttgttactcgggaagggctttacctcttccgcataaacgcttccatcagcgtttatagttaaaaaaatctttcggaactggttttgcgcttaccccaaccaacaggggatttgctgctttccattgagcctgtttctctgcgcgacgttcgcggcggcgtgtttgtgcatccatctggattctcctgtcagttagctttggtggtgtgtggcagttgtagtcctgaacgaaaaccccccgcgattggcacattggcagctaatccggaatcgcacttacggccaatgcttcgtttcgtatcacacaccccaaagccttctgctttgaatgctgcccttcttcagggcttaatttttaagagcgtcaccttcatggtggtcagtgcgtcctgctgatgtgctcagtatcaccgccagtggtatttatgtcaacaccgccagagataatttatcaccgcagatggttatctgtatgttttttatatgaatttattttttgcaggggggcattgtttggtaggtgagagatcaattctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 288 - DNA, 1583 bp, Artificial Sequence
  artificial construct
caccatcgaatggcgcaaaacctttcgcggtatggcatgatagcgcccggaagagagtcaagtgtaggctggagctgcttcgaagttcctatactttctagagaataggaacttcggaataggaacttcggaataggaactaaggaggatattcatatgtactatttaaaaaacacaaacttttggatgttcggtttattctttttcttttacttttttatcatgggagcctacttcccgtttttcccgatttggctacatgacatcaaccatatcagcaaaagtgatacgggtattatttttgccgctatttctctgttctcgctattattccaaccgctgtttggtctgctttctgacaaactcgggctgcgcaaatacctgctgtggattattaccggcatgttagtgatgtttgcgccgttctttatttttatcttcgggccactgttacaatacaacattttagtaggatcgattgttggtggtatttatctaggcttttgttttaacgccggtgcgccagcagtagaggcatttattgagaaagtcagccgtcgcagtaatttcgaatttggtcgcgcgcggatgtttggctgtgttggctgggcgctgtgtgcctcgattgtcggcatcatgttcaccatcaataatcagtttgttttctggctgggctctggctgtgcactcatcctcgccgttttactctttttcgccaaaacggatgcgccctcttctgccacggttgccaatgcggtaggtgccaaccattcggcatttagccttaagctggcactggaactgttcagacagccaaaactgtggtttttgtcactgtatgttattggcgtttcctgcacctacgatgtttttgaccaacagtttgctaatttctttacttcgttctttgctaccggtgaacagggtacgcgggtatttggctacgtaacgacaatgggcgaattacttaacgcctcgattatgttctttgcgccactgatcattaatcgcatcggtgggaaaaacgccctgctgctggctggcactattatgtctgtacgtattattggctcatcgttcgccacctcagcgctggaagtggttattctgaaaacgctgcatatgtttgaagtaccgttcctgctggtgggctgctttaaatatattaccagccagtttgaagtgcgtttttcagcgacgatttatctggtctgtttctgcttctttaagcaactggcgatgatttttatgtctgtactggcgggcaatatgtatgaaagcatcggtttccagggcgcttatctggtgctgggtctggtggcgctgggcttcaccttaatttccgtgttcacgcttagcggccccggcccgctttccctgctgcgtcgtcaggtgaatgaagtcgcttaagcaatcaatgtcggatgcggcgcgagcgccttatccgaccaacatatcataacggagtgatcgcattgtaaattataaaaattgcctgatacgctgcgcttatcaggcctacaagttcagcgatctacattagccgcatccggcatgaacaaagcgcaggaacaagcgtcgca

SEQ ID NO: 289 - DNA, 2070 bp, Artificial Sequence
  artificial construct
gttcggttatatcaatgtcaaaaacctcacgccgctcaagctggtgatcaactccgggaacggcgcagcgggtccggtggtggacgccattgaagcccgctttaaagccctcggcgcgcccgtggaattaatcaaagtgcacaacacgccggacggcaatttccccaacggtattcctaacccactactgccggaatgccgcgacgacacccgcaatgcggtcatcaaacacggcgcggatatgggcattgcttttgatggcgattttgaccgctgtttcctgtttgacgaaaaagggcagtttattgagggctactacattgtcggcctgttggcagaagcattcctcgaaaaaaatcccggcgcgaagatcatccacgatccacgtctctcctggaacaccgttgatgtggtgactgccgcaggtggcacgccggtaatgtcgaaaaccggacacgcctttattaaagaacgtatgcgcaaggaagacgccatctatggtggcgaaatgagcgcccaccattacttccgtgatttcgcttactgcgacagcggcatgatcccgtggctgctggtcgccgaactggtgtgcctgaaagataaaacgctgggcgaactggtacgcgaccggatggcggcgtttccggcaagcggtgagatcaacagcaaactggcgcaacccgttgaggcgattaaccgcgtggaacagcattttagccgtgaggcgctggcggtggatcgcaccgatggcatcagcatgacctttgccgactggcgctttaacctgcgcacctccaataccgaaccggtggtgcgcctgaatgtggaatcgcgcggtgatgtgccgctgatggaagcgcgaacgcgaactctgctgacgttgctgaacgagtaatgtcggatcttcccttaccccactgcgggtaaggggctaataacaggaacaacgatgattccggggatccgtcgacctgcagttcgaagttcctattctctagaaagtataggaacttcgaagcagctccagcctacagttaacaaagcggcatattgatatgagcttacgtgaaaaaaccatcagcggcgcgaagtggtcggcgattgccacggtgatcatcatcggcctcgggctggtgcagatgaccgtgctggcgcggattatcgacaaccaccagttcggcctgcttaccgtgtcgctggtgattatcgcgctggcagatacgctttctgacttcggtatcgctaactcgattattcagcgaaaagaaatcagtcaccttgaactcaccacgttgtactggctgaacgtcgggctggggatcgtggtgtgcgtggcggtgtttttgttgagtgatctcatcggcgacgtgctgaataacccggacctggcaccgttgattaaaacattatcgctggcgtttgtggtaatcccccacgggcaacagttccgcgcgttgatgcaaaaagagctggagttcaacaaaatcggcatgatcgaaaccagcgcggtgctggcgggcttcacttgtacggtggttagcgcccatttctggccgctggcgatgaccgcgatcctcggttatctggtcaatagtgcggtgagaacgctgctgtttggctactttggccgcaaaatttatcgccccggtctgcatttctcgctggcgtcggtggcaccgaacttacgctttggtgcctggctgacggcggacagcatcatcaactatctcaataccaacctttcaacgctcgtgctggcgcgtattctcggcgcgggcgtggcagggggatacaacctggcgtacaacgtggccgttgtgccaccgatgaagctgaacccaatcatcacccgcgtgttgtttccggcattcgccaaaattcaggacgataccgaaaagctgcgtgttaacttctacaagctgctgtcggtagtggggattatcaactttccggcgctgctcgggctaatggtggtgtcgaataactttgtaccgctggtctttggtgagaagtggaacagcattattccggtgctgcaattgctgtgtgtggtgggtctgctgcgctccg

SEQ ID NO: 290 - DNA, 5046 bp, Artificial Sequence
  artificial construct
gtggatggaagaggtggaaaaagtggttatggaggagtgggtaattgatggtgaaaggaaagggttggtgatttatgggaagggggaaggggaagagggatgtggtgaataattaaggattgggatagaattagttaaggaaaaaggggggattttatgtggggtttaatttttggtgtattgtgggggttgaatgtgggggaaagatggggatatagtgaggtagatgttaatagatggggtgaaggagagtggtgtgatgtgattaggtgggggaaattaaagtaagagagaggtgtatgattggggggatgggtggaggtggagttggaagttggtattgtgtagaaagtataggaagttgagaggggttttgaaggtgagggtgggggaaggagtgaggggggaaggggtggtaaaggaaggggaagaggtagaaagggagtggggagaaagggtggtgaggggggatgaatgtgaggtagtggggtatgtggagaagggaaaagggaaggggaaagagaaaggaggtaggttggagtggggttagatggggataggtagagtggggggttttatggagaggaagggaaggggaattgggaggtgggggggggtgtggtaaggttgggaaggggtggaaagtaaagtggatgggtttgttggggggaaggatgtgatgggggaggggatgaagatgtgatgaagagagaggatgaggatggtttgggatgattgaagaagatggattggagggaggttgtggggggggttgggtggagagggtattggggtatgagtggggagaagagagaatggggtggtgtgatgggggggtgttgggggtgtgaggggagggggggggggttgtttttgtgaagagggaggtgtggggtggggtgaatgaagtggaggaggagggagggggggtatggtgggtggggaggaggggggttggttggggaggtgtggtggaggttgtgagtgaagggggaagggagtgggtggtattgggggaagtggggggggaggatgtggtgtgatgtgaggttggtggtggggagaaagtatggatgatgggtgatggaatggggggggtggatagggttgatgggggtaggtggggattggaggaggaagggaaagatgggatggagggaggaggtagtgggatggaagggggtgttgtggatgaggatgatgtggaggaagaggatgagggggtggggggaggggaagtgttggggagggtgaaggggggatgggggagggggaggatgtggtggtgagggatggggatgggtggttggggaatatgatggtggaaaatggggggttttgtggattgatggagtgtgggggggtgggtgtgggggaggggtatgaggagatagggttgggtaggggtgatattggtgaagaggttgggggggaatggggtgaggggttggtggtggtttagggtatggggggtggggattgggaggggatggggttgtatggggttgttgaggagttgttgtaataaggggatgttgaagttggtattgggaagttggtattgtgtagaaagtataggaagttggaaggaggtggagggtagataaaggggggggttatttttgagaggagaggaagtggtaatggtagggagggggggtgaggtggaattggggggatagtgagggggtggaggagtggtggggaggaatggggatatggaaagggtggatattgagggatgtgggttgttgggggtggaggagatggggatgggtggtttggatgagttggtgttgagtgtagggggtgatgttgaagtggaagtgggggggggagtggtgtgggggataattgaattggggggtgggggaggggagagggttttgggtggggaagaggtagggggtatagatgttgagaatgggagatgggaggggtgaaaagaggggggagtaagggggtggggatagttttgttgggggggtaatgggagggagtttagggggtgtggtaggtgggggaggtgggagttgaggggaatgggggggggatggggtgtatgggtggggagttgaagatgaagggtaatggggatttgaggagtaggatgaatggggtaggttttgggggtgataaataaggttttggggtgatggtgggaggggtgaggggtggtaatgaggaggggatgaggaagtgtatgtggggtggagtggaagaagggtggttgggggtggtaatgggggggggggttggagggttggagggaggggttagggtgaatgggggtgggttgagttaggggaatgtggttatggaggggtggaggggtgaagtgatgggggaggggggtgaggagttgttttttatggggaatggagatgtgtgaaagaaagggtgagtgggggttaaattgggaagggttattagggaggtggatggaaaaatggatttgggtggtggtgagatgggggatggggtgggaggggggggggagggtgagagtgaggttttgggggagaggggagtggtgggagggggtgatgtgggggggttgtgaggatggggtggggttgggttggagtaggggtagtgtgagggagagttgggggggggtgtgggggtggggtagttgagggagttgaatgaagtgtttaggttgtggagggagatggagagggagttgaggggttgggagggggttaggatggagggggaggatggagtggaggaggtggttatgggtatgagggaagaggtattgggtggtgagttggatggtttggggggataaagggaagtggaaaaagtggtggtggtgttttggttgggtgaggggtggatggggggtggggtggggaaagaggagagggttgatagagaagtggggatggttgggggtatggggaaaatgaggggggtaaggggaggaggggttggggttttgatgatatttaatgagggagtgatggagggagtgggagaggaagggggggtgtaaagggggatagtgaggaaaggggtgggagtatttagggaaagggggaagagtgttagggatggggtgggggtattgggaaaggatgagggggggggtgtgtggaggtagggaaagggattttttgatggaggatttggggagaggggggaaggggtggtgttgatggaggggggggtagatgggggaaataatatgggtgggggtggtgtggggtggggggggttgatagtggagggggggggaaggatggagagatttgatggagggatagagggggtggtgattaggggggtggggtgattgattggggagggaggagatgatgagagtggggtgattaggatgggggtggaggattggggttaggggttgggtgatggggggtagggaggggggatgatgggtgagaggattgattgggaggatggggtgggtttgaatattgggttgatggaggagatagagggggtaggggtgggagagggtgtaggagaggggatggttgggataatgggaagaggggagggggttaaagttgttgtggttgatgaggaggatatggtggaggatggtgtggtgatggatgaggtgaggatggagaggatgatggtggtgagggttaaggggtggaatgaggaaggggttggggttgaggaggaggagaggattttgaatggggaggtgggggaaagggagatgggagggttgtggttgaatgagggtggggtggggggtgtggagttgaaggaggggaggatagagattggggatttggggggtggagagtttggggttttggaggttgagaggtagtgtgaggggatggggataaggaggagggtgatggataatttgaggggggaaagggggggtgggggtggggaggtgggtttgagggtgggataaagaaagtgttaggggtaggtagtgagggaagtggggggagatgtgaagttgagggtggagtagagggggggtgaaatgatgattaaagggagtgggaagatggaaatgggtgatttgtgtagtgggtttatggaggaaggagaggtgagggaaaatgggggtgatgggggagatatggtgatgttggagataagtggggtgagtggaggggaggaggatgagggggagggggttttgtggggggggtaaaaatggggtgaggtgaaattgagaggggaaaggagtgtggtgggggtaagggagggagggggggttggaggagagatgaaagggggagttaaggggatgaaaaataattggggtgtggggttggtgtagggaggtttgatgaagattaaatgtgagggagtaagaaggggtgggattgtgggtgggaagaaaggggggattgagggtaatgggataggtgaggttggtgtagatggggggatggtaagggtggatgtgggagtttgaggggaggaggagagtatgggggtgaggaagatgggagggagggaggtttgggggaggggttgtggtgggggaaaggagggaaagggggattggggattgagggtggggaagtgttgggaagggggatgggtgggggggtgttgggtattaggggaggtggggaaagggggatgtggtggaaggggattaagttgggtaaggggagggttttgggagtgaggaggttgtaaaaggagggggagtgaatgggtaatgatggtgatagtaggtttggtgaggttgtgagtggaaaatagtgaggtgggggaaaatggagtaataaaaagaggggtgggagggtaattgggggttgggagggtttttttgtgtgggtaagttagatgggggatgggggttggggttattaaggggtgttgtaaggggatgggtggggtgatataagtggtgggggttggtaggttgaaggattgaagtgggatataaattataaagaggaagagaagagtgaataaatgtgaattgatggagaagattggtggagggggtgatatgtgtaaaggtgggggtgggggtgggttagatggtattattggttgggtaagtgaatgtgtgaaagaagg

SEQ ID NO: 291 - DNA, 6155 bp, Artificial Sequence
  artificial construct
tctagaattctaaaaattgattgaatgtatgcaaataaatgcatacaccataggtgtggtttaatttgatgccctttttcagggctggaatgtgtaagagcggggttatttatgctgttgtttttttgttactcgggaagggctttacctcttccgcataaacgcttccatcagcgtttatagttaaaaaaatctttcggaactggttttgcgcttaccccaaccaacaggggatttgctgctttccattgagcctgtttctctgcgcgacgttcgcggcggcgtgtttgtgcatccatctggattctcctgtcagttagctttggtggtgtgtggcagttgtagtcctgaacgaaaaccccccgcgattggcacattggcagctaatccggaatcgcacttacggccaatgcttcgtttcgtatcacacaccccaaagccttctgctttgaatgctgcccttcttcagggcttaatttttaagagcgtcaccttcatggtggtcagtgcgtcctgctgatgtgctcagtatcaccgccagtggtatttatgtcaacaccgccagagataatttatcaccgcagatggttatctgtatgttttttatatgaatttattttttgcaggggggcattgtttggtaggtgagagatcaattctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatatgcggtgtgaaataccgcacagatgcgtaaggagaaaataccgcatcaggcgcctcctcaacctgtatattcgtaaaccacgcccaatgggagctgtctcaggtttgttcctgattggttacggcgcgtttcgcatcattgttgagtttttccgccagcccgacgcgcagtttaccggtgcctgggtgcagtacatcagcatggggcaaattctttccatcccgatgattgtcgcgggtgtgatcatgatggtctgggcatatcgtcgcagcccacagcaacacgtttcctgaggaaccatgaaacagtatttagaactgatgcaaaaagtgctcgacgaaggcacacagaaaaacgaccgtaccggaaccggaacgctttccatttttggtcatcagatgcgttttaacctgcaagatggattcccgctggtgacaactaaacgttgccacctgcgttccatcatccatgaactgctgtggtttctgcagggcgacactaacattgcttatctacacgaaaacaatgtcaccatctgggacgaatgggccgatgaaaacggcgacctcgggccagtgtatggtaaacagtggcgcgcctggccaacgccagatggtcgtcatattgaccagatcactacggtactgaaccagctgaaaaacgacccggattcgcgccgcattattgtttcagcgtggaacgtaggcgaactggataaaatggcgctggcaccgtgccatgcattcttccagttctatgtggcagacggcaaactctcttgccagctttatcagcgctcctgtgacgtcttcctcggcctgccgttcaacattgccagctacgcgttattggtgcatatgatggcgcagcagtgcgatctggaagtgggtgattttgtctggaccggtggcgacacgcatctgtacagcaaccatatggatcaaactcatctgcaattaagccgcgaaccgcgtccgctgccgaagttgattatcaaacgtaaacccgaatccatcttcgactaccgtttcgaagactttgagattgaaggctacgatccgcatccgggcattaaagcgccggtggctatctaattacgaaacatcctgccagagccgacgccagtgtgcgtcggtttttttaccctccgttaaattcttcgagacgccttcccgaaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagctttctttaatgaagcagggcatcaggacggtatctttgtggagaaagcagagtaatcttattcagcctgactggtgggaaaccaccagtcagaatgtgttagcgcatgttgacaaaaataccattagtcacattatccgtcagtcggacgacatggtagataacctgtttattatgcgttttgatcttacgtttaatattacctttatgcgatgaaacggtcttggctttgatattcatttggtcagagatttgaatggttccctgacctgccatccacattcgcaacatactcgattcggttcggctcaatgataacgtcggcatatttaaaaacgaggttatcgttgtctcttttttcagaatatcgccaaggatatcgtcgagagattccggtttaatcgatttagaactgatcaataaattttttctgaccaatagatattcatcaaaatgaacattggcaattgccataaaaacgataaataacgtattgggatgttgattaatgatgagcttgatacgctgactgttagaagcatcgtggatgaaacagtcctcattaataaacaccactgaagggcgctgtgaatcacaagctatggcaaggtcatcaacggtttcaatgtcgttgatttctctttttttaacccctctactcaacagatacccggttaaacctagtcgggtgtaactacataaatccataataatcgttgacatggcataccctcactcaatgcgtaacgataattccccttacctgaatatttcatcatgactaaacggaacaacatgggtcacctaatgcgccactctcgcgatttttcaggcggacttactatcccgtaaagtgttgtataatttgcctggaattgtcttaaagtaaagtaaatgttgcgatatgtgagtgagcttaaaacaaatatttcgctgcaggagtatcctggaagatgttcgtagaagcttactgctcacaagaaaaaaggcacgtcatctgacgtgccttttttatttgtactaccctgtacgattactgcagctcgagttaggataccggcactttgatccaaccagtcgggtagatatccggtgcttcggagtgctggaaccaacggctcggcacaataacagtcttatccatattagggttcagccaggcaccccaccaagaaaacgtgctgttacaaatgatgtgatgtttgcaatgagacatcagcatcatatcctgccaggagtcttcatcagtgttccagtcaatataaaccgcattctgcagtggcagattttctttaacccacgcgatatcgtcggagaagatatagtaagatgggctagcaacacgacgggacatttccgcgatagcattctggtaatacggcagctggcacacggaaccggtagtagcccagtgtttcggctgcagatagtcaccacgacgaatgtgcagggaaaccgcgttttcatctttgtccaggatttccagcatgttcaggctgcgggaatttgctttgttcttatcaaaggtgaaggattcacgcacttcgtctttgatatcagcgaagaaacgctcgctctgatagaaacctttaaagtacagcagcggccagaaatacttcttctcgaacgcacgcagagagttcggcgcctgcttgcgttcgtagatttttttaaaaaacaggaattcgataacttttttcagcggttggttgatgcagaattcggtgtgcggcaggttgaacacgcggtgcatttcgtaaccgtaatggactttgtaatgcatcatgtcgctcaggtcgatacggaccttcgggtaatactttttcatacgcagatagaaagcatagataaacatctggttgcccagaccgccagtcactttgatcagacgcattatatctccttcttg

SEQ ID NO: 292 - protein, 278 aa, Artificial Sequence
  artificial construct
  MISC_FEATURE (1)..(13): wherein X is any amino acid
XXXXXXXXXXXXXMFQYALYKAFEQKHIDVYADLAWYKNKSVKFELYNFGIKINVASEKDINRLSDCQADFVSRIRRKIFGKKKSFVSEKNDSCYENDILRMDNVYLSGYWQTEKYFSNTREKLLEDYSFALVNSQVSEWEDSIRNKNSVSIHIRRGDYLQGELYGGICTSLYYAEAIEYIKMRVPNAKFFVFSDDVEWVKQQEDFKGFVIVDRNEYSSALSDMYLMSLCKHNIIANSSFSWWAAWLNRNEEKIVIAPRRWLNGKCTPDIWCKKWIRI

What is claimed is:

1. A method for producing a fucosylated lacto-N-fucopentaose I (LNF I) oligosaccharide in a bacterium comprising
    providing a bacterium comprising an exogenous lactose-utilizing α(1,2) fucosyltransferase enzyme, wherein said α(1,2) fucosyltransferase enzyme has at least 90% sequence identity to amino acid sequence SEQ ID NO: 13; and
    culturing said bacterium in the presence of lactose, wherein said LNF I oligosaccharide is produced,
    wherein said bacterium further comprises β1,3-N-acetylglucosaminyltransferase and β1,3-galactosyltransferase.

2. The method of claim 1, wherein said α(1,2) fucosyltransferase enzyme comprises *Methanosphaerula palustries* FutR.

3. The method of claim 1, further comprising retrieving the fucosylated oligosaccharide from said bacterium or from a culture supernatant of said bacterium.

4. The method of claim 1, wherein said bacterium further produces 2'-fucosyllactose (2'-FL), lactodifucotetraose (LDFT), or lacto-N-difucohexaose I (LDFH I).

5. The method of claim 1, wherein the bacterium further comprises an exogenous lactose-utilizing α(1,3) fucosyltransferase enzyme and/or an exogenous lactose-utilizing α(1,4) fucosyltransferase enzyme.

6. The method of claim 5, wherein the exogenous lactose-utilizing α(1,3) fucosyltransferase enzyme comprises a *Helicobacter pylori* 26695 futA gene.

7. The method of claim 5, wherein the exogenous lactose-utilizing α(1,4) fucosyltransferase enzyme comprises a *Helicobacter pylori* UA948 FucTa gene or a *Helicobacter pylori* strain DMS6709 FucT III gene.

8. The method of claim 1, wherein said bacterium further comprises a reduced level of β-galactosidase activity, a defective colanic acid synthesis pathway, an inactivated adenosine-5'-triphosphate (ATP)-dependent intracellular protease, or an inactivated endogenous lacA gene, or any combination thereof.

9. The method of claim 8, wherein said method further comprises culturing said bacterium in the presence of tryptophan and in the absence of thymidine.

10. The method of claim 8, wherein said reduced level of β-galactosidase activity comprises a deleted or inactivated endogenous lacZ gene and/or a deleted or inactivated endogenous lacI gene of said bacterium.

11. The method of claim 10, wherein said reduced level of β-galactosidase activity further comprises an exogenous lacZ gene, wherein said exogenous lacZ gene comprises an β-galactosidase activity level less than wild-type bacterium.

12. The method of claim 8, wherein said reduced level of β-galactosidase activity comprises an activity level less than wild-type bacterium.

13. The method of claim 12, wherein said reduced level of β-galactosidase activity comprises less than 6,000 Miller units of β-galactosidase activity.

14. The method of claim 12, wherein said reduced level of β-galactosidase activity comprises less than 1,000 Miller units of β-galactosidase activity.

15. The method of claim 8, wherein said bacterium comprises a lack gene promoter immediately upstream of a lacY gene.

16. The method of claim 8, wherein said defective colanic acid synthesis pathway comprises the inactivation of a wcaJ gene of said bacterium is deleted.

17. The method of claim 8, wherein said inactivated ATP-dependent intracellular protease is a null mutation, inactivating mutation, or deletion of an endogenous lon gene.

18. The method of claim 17, wherein said inactivating mutation of an endogenous lon gene comprises the insertion of a functional *E. coli* lacZ+ gene.

19. The method of claim 8, wherein said bacterium further comprises a functional lactose permease gene.

20. The method of claim 19, wherein said bacterium comprises *E. coli* lacY.

21. The method of claim 8, wherein said bacterium further comprises an exogenous *E. coli* rcsA or *E. coli* rcsB gene.

22. The method of claim 8, wherein said bacterium further comprises a mutation in a thyA gene.

23. The method of claim 8, wherein said bacterium accumulates intracellular lactose in the presence of exogenous lactose.

24. The method of claim 8 wherein said bacterium accumulates intracellular GDP-fucose.

25. The method of claim 1, wherein said bacterium is *E. coli*.

26. The method of claim 1, wherein said production strain is a member of the *Bacillus, Pantoea, Lactobacillus, Lactococcus, Streptococcus, Proprionibacterium, Enterococcus, Bifidobacterium, Sporolactobacillus, Micromomospora, Micrococcus, Rhodococcus,* or *Pseudomonas* genus.

27. The method of claim 1, wherein said production strain is selected from the group consisting of *Bacillus licheniformis, Bacillus subtilis, Bacillus coagulans, Bacillus thermophiles, Bacillus laterosporus, Bacillus megaterium, Bacillus mycoides, Bacillus pumilus, Bacillus lentus, Bacillus cereus,* and *Bacillus circulans, Erwinia herbicola (Pantoea agglomerans), Citrobacter freundii, Pantoea citrea, Pectobacterium carotovorum, Xanthomonas campestris Lactobacillus acidophilus, Lactobacillus salivarius, Lactobacillus plantarum, Lactobacillus helveticus, Lactobacillus delbrueckii, Lactobacillus rhamnosus, Lactobacillus bulgaricus, Lactobacillus crispatus, Lactobacillus gasseri, Lactobacillus casei, Lactobacillus reuteri, Lactobacillus jensenii, Lactococcus lactis, Streptococcus thermophiles, Proprionibacterium freudenreichii, Enterococcus faecium, Enterococcus thermophiles), Bifidobacterium longum, Bifidobacterium infantis, Bifidobacterium bifidum, Pseudomonas fluorescens* and *Pseudomonas aeruginosa*.

28. The method of claim 1, wherein said bacterium comprises a nucleic acid construct comprising an isolated nucleic acid encoding said α(1,2) fucosyltransferase enzyme.

29. The method of claim 28, wherein said nucleic acid is operably linked to one or more heterologous control sequences that direct the production of the enzyme in the bacterium.

30. The method of claim 29, wherein said heterologous control sequence comprises a bacterial promoter and operator, a bacterial ribosome binding site, a bacterial transcriptional terminator, or a plasmid selectable marker.

31. The method of claim 1, wherein the amino acid sequence of said enzyme comprises the amino acid sequence of FutR (SEQ ID NO: 13).

\* \* \* \* \*

UNITED STATES PATENT AND TRADEMARK OFFICE
CERTIFICATE OF CORRECTION

| | |
|---|---|
| PATENT NO. | : 11,046,984 B2 |
| APPLICATION NO. | : 15/307914 |
| DATED | : June 29, 2021 |
| INVENTOR(S) | : John M. McCoy et al. |

It is certified that error appears in the above-identified patent and that said Letters Patent is hereby corrected as shown below:

In the Claims

Column 134 Line 49 In Claim 15, replace "a lack gene promoter" with --a *lacIq* gene promoter--

Signed and Sealed this
Seventh Day of June, 2022

Katherine Kelly Vidal
*Director of the United States Patent and Trademark Office*